United States Patent 7,745,391 (HUMAN THROMBOSPONDIN POLYPEPTIDE) - sequence listing, part 43

SEQ ID NO: 105723 - DNA, 3540 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta

SEQ ID NO: 105724 - DNA, 3215 bp, Homo sapiens
agcggacgatcagaatatagaaggcatgctttaatgttcttgggcaaacatgctgtgtatgtgctcaggacattacttacaagaaaatcactttttaaaaagaaccttttctttttacggaatattgaagaaaaattgaattggcagcaagagtgaaacagtttaagtgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta

SEQ ID NO: 105725 - DNA, 3613 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggcccatgcagtccagttcgggagctaagtcacttaaacactgtgtgatagttcctacacatctcattatagtttgtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta

SEQ ID NO: 105726 - DNA, 3542 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagtgcctccacttctcattcagagaattcagtgcatacaaaatcagcttctgttgtatcatcagattccatttcaacttctgccgacaacttttctcctgatttgaggcccatgcagtccagttcgggagctaagtcacttaaacactgtgtgatagttcctacacatctcattatagtttgtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta

SEQ ID NO: 105727 - DNA, 3592 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagtgcctccacttctcattcagagaattcagtgcatacaaaatcagcttctgttgtatcatcagattccatttcaacttctgccgacaacttttctcctgatttgaggagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta

SEQ ID NO: 105728 - DNA, 2645 bp, Homo sapiens
gcttttagaactgagcagttttactaatatattaagtggggtttacttagccctgtttcacagtatttttttcaggagataacatttcccaataatcaaatactttcctaaatcagtatctgactaaagaattagaccaagttttccacatcccagaattggcttgaaggaaaggtgatgatttttcttagcagcctcagatgtcctttcatggccaggctttggatccaattagaaagcagagctttactgagtactgtttttgagaattataaacagagaagtatgtaaaaggtgtgttaccattttttcctcattaaggttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgactttta

SEQ ID NO: 105729 - DNA, 3022 bp, Homo sapiens
cgttacactcactccaagcatgggctggctacaccgagtgattgtggcttgattttcaggatgaatccatgataaaactgggatacggcctcttgatctgaaggatgccactctctttaattcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaaatttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaatgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataacttcgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 105730 - DNA, 3857 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaaatttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaatgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataacttcgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 105731 - DNA, 2504 bp, Homo sapiens
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagacgagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggtatgtgccttacaatatacaatgggagttttcattcatgcagtgcaactttgtctccgtaaaagcagctggaaagattatctgtgcatatttaaaactttactccttccttggcaacattctggaacctcttgccatcaaattcgggaagggcctgggctcacattatggaggtggatcctctagagcgagccatgag

SEQ ID NO: 105732 - DNA, 355 bp, Homo sapiens
atcagaatatagaaggcatgctttaatgttcttgggcaaacatgctgtgtatgtgctcaggacattacttacaagaaaatcactttttaaaaagaaccttttctttttacggaatattgaagaaaaattgaattggcagcaagagtgaaacagtttaaggcaagtggtttagatcttattgtaatgactatggtcagtagaaatgcagcctctcctaaatcttctagaggcatttgtttactaggatatatgaaaagatagatgacttgaagtttccaggttgttttcactttagagtatatactctaaagtgtatatactctttatatgtttgttcatctgcatctttaatttt

SEQ ID NO: 105733 - DNA, 846 bp, Homo sapiens
gcaaggttccagacatgtgagggatgtggctaaggttgacctggaaaaaggaatgctgggagcctgggaggtggaaggacactggaggagctggcggtggacagagcggggccgcccccatgcctccaagacccgctttcacgtctgcaaaatgagatggaaagccatgcctcccagggcttctggtggctggcaggtgacagagagggcaccgcgggcctccagttcttcccgagtcccccagggccttgcctgggcccatcagcagcagcaggccttccgcaaagacttgctgaattaacaaatgcctgagggagggagaggggaactcacactagttgtggtcatggtagatttctgtcctgaagaatggggaattacagcgttgctgggctccctgtgatggggcagcaggactgaggcctgcgcgagtgagtatagacgctgtggtctgtgtgcagcccacttgccttcagagctctgccacggcaggccccctttagctcctctgttgctttacaataaactcgctgggtgtggtggctcacgcctataatcctagcactttgggaggctgaggcaggtggatcacctgaggtcaggagtttgagaccagcctggccaacatggtgaaatcccgtctctactaaaaatacaaaagttagccgggcgtggtggcacctgcctctaatcccagctactcaggagactgaggcaggagaatcacttgaacccaggaggcagaggttgcagtgagcagagattgcaccactgcactccaaactgggtgacagagagagtctgtctcaaaacaaaacaaaaaattaaacattaaaaaaggcaggc

SEQ ID NO: 105734 - DNA, 249 bp, Homo sapiens
tctgtgggaagctttaagccactactgacacctataacacacacctggtagaaaatgctgtgcaggggtagacaaagaactacaagtgtccctgtacagaagagcatgaaaagtcttaagaacctgagcctggtcaggcatggtggctcatgcctgtaatcccaacactttgggagaccgaagtgggtagaccacttgagcccaggagttcaagaccagcctgagcaacatagtgatacctcatctctt

SEQ ID NO: 105735 - DNA, 326 bp, Homo sapiens
cacaccactgaattataatagtgtctttgggaataaatagctttgaggaccttagaagaaaaacagtactttgttgcagaaaatgatagctttgttataataggggagttatatatctctctctctttcagtccttgaaaaacctcctcacagtttctagtctagcataaaaacaaagcactatttaaaaatatgttcagtatacgcttctataagcctactaatttatgacctcatgctgtcttctgattaacaaagcaaaacaatgccaaggacttattacctctgtaaattccatgttttttgagatcctctttctgtaattt

SEQ ID NO: 105736 - DNA, 334 bp, Homo sapiens
tttagggagcttgctttttgagatggtactgacaggccagagaggagggcagaggggctgcaagctcccacatgggctgatgtgtgctcccaggagggagctgaaaccctggggccttgtgagccgccagcagaaaaatcggcttggaaggctgggcgtggtggttcacctgtgtaaccccagaaaaatcggctttgggaggccgaggcagtcggatcacttcaggtcgggaattcgagaccagcctggccaacatggtgaaaccccgtctctactaaaaatgcaaaaaaaaattagccaggcgtggtggctggtgcccgtaatccagctactc

SEQ ID NO: 105737 - DNA, 238 bp, Homo sapiens
tctttgcttggttcccatagcattgtgtgcatatcaaatctaacataatttaggtctgtttccctgccactaaattgtgagccctctgcaagtaaatactgaattacttatctctgaatcttgaatatatgctagaataattatttcatgacaaaagattttggaatgaatgatcaagaagaaaaaaggcaaaaaaacccactcagaaataataaagaatcattagtgatgcactaat

SEQ ID NO: 105738 - DNA, 333 bp, Homo sapiens
ctaccaggactgcttggcaaatactgaccgacagccatccaaacccctgcccgcgaagtgaagcttttttcctttttgaaaaaaagagtccaaacctaaaactatttccagttaacggaactgcaacatatgaggcagaggagaattattccaggaaaatggatttttcacttttaaatatacatcaatgcattttttgttttttgtttttgtttttgggttttttgtttttttttttggagagggagtctcacttttgtggcccagcttggggggcaatggtccaatttgggttaactgcaacctcggttaccgggactcgcttttggggac

SEQ ID NO: 105739 - DNA, 753 bp, Homo sapiens
ggcgctttgaaagggcattgggacagcatcacagaatgtcagtgtcccacatttgcgaggagtcccgggccccagttcttacactgcagtttgcatgaggatgggccaccgccacttccgcctggggttgtctggtgatgcccccaggagagacgcgcccactgaaaagccagcgtggtgtcctcttacacggtccttaacaaactctgggactctgggggtgcaggaaataccacaggaccgtcattactcccataccggctgagtcacaactgtattgcaggaggcttcttggaacgcctatgtaactttaatggaagtgaccaggtacagatcttctacagcaaggaaggaatcttagtgctagaattcagttgagcctttgagttggctcttcttataagtgagcaaacaagtaacaaggtttagggggcgcccatttttgtgttagcacgattgccctcgtgtttaatatttcccaagccctattatgataaggagttggacttaatgaagaaccatgttgtcaaacatcttatgcccatcttgaagttgtgaaggaggatgagcaccaagaaaaggaaataaataaaatccaatacgggccgggtgcggtagctcacgcctgtaatcttagcagtttgggaggccaaggcaggcagaactcttgagcccagaaattcaagaccagcctaggcagcatagtgagaccccgtctctacaaaaaatataattagctgggcgtggtggcaa

SEQ ID NO: 105740 - DNA, 406 bp, Homo sapiens
agaatgccattatacttattcactgaaaactattaaaaatgataataaaagttatgtggccagtttaacaacaacaattaagaatcagctttacaatataagtggtgactagttaaaaatattataatacgaggagtccatatctaaaagcaacaaaaatatttttggaaacttaaaaaaagaacatgaagaaaattttggaacccttaccagcctggccaacatgataaagccccgtctctactaaaaatacaaaaattagtcatgtgtggtggcaggggcctgtatcccagccacttgggaggctgagaaaggagaatcttgaacctgggaggcagaggctgcaatgagctgagattacaccaccacattccagcctgggcggcagagtaaaactcttgtctca

SEQ ID NO: 105741 - DNA, 326 bp, Homo sapiens
gtatttgaagcatttcttattaatgaaatgagaaaatgcattcttaaaacactagacagtactttcaataaatgggttatgtctatatctaaaaaaatcctgtttaataaaaaaattagtttgtggcatgatatgcttattgtgatattaacataaatctagaaatactgtagaatttccatgaattcgtgtacatgtgtatacaaacataaagaacttgaagaatctgaatctaatcttttatacctcagaaaagatgaataaaatgtaacattattttgttaataattattatattctgctaaagtcaagtctgttgtgccagg

SEQ ID NO: 105742 - DNA, 725 bp, Homo sapiens
tctactaaaaatacaaaattagccgggtgtggtggcacatgcctgtaatcccagctactcaggaggccggggcaggagaatcacttgaacctgagaggaggaggttgcagtaagccgagatcgtgcctctggactccagcctgggcaacagagcaagactctttctcaaaaataaataaataaataacgacaaaaaataaagacagtatctggcatattgtaggtgtccagtgaatatttgttgaatgaaaaaagaatgattaagacagtatattaagagggatcacttattgcaatttcctctgaccatgccagtgtagattctgtccctacttgtaattaattattcttacatctgtattcctatgcttctttgtgaatagtcatactgccatttgctactatatttatttaatcacaataatttatgcctatacttccctgcttgaaaaatgtttgcttgtgtctctacggaaatgttaagtaacattattcagcacatgcaacatgaaaggtgctggtctaagtgtgctctgtatgggttaactcttttcatgctgtcaacaattattaagatagatactaatgctatattatctagattctctatataggaatactggagcgtagagtgatttgtttgaatttgtacagctagtaagtggtcgagctttgattcaaaccctggcagtcagctgggtacttgcattcttaagcaacaggct

SEQ ID NO: 105743 - DNA, 242 bp, Homo sapiens
aacaaacccagagccagactttgtctcacacaataaaaagaatagccaatgtattaagaaattaagccttaggccaagcgcagtggcttacacctgtaatcccagcactttgagaggccaaggtgggtggatcacctgaggacaggagttcaagaccagcctgatgaagtcccgtctctactaaaaatacaaaaattagctgggtgtggtggtgggtgcctgtaatcccagctactcaggag

SEQ ID NO: 105744 - DNA, 773 bp, Homo sapiens
aaaatcacctcttcaatcagagtaccaattctgaaatttacccaggagctgacttcttaggaaagggctttctggaatcccggaatgaaaaggttgatgttcgtgagaataaacatgcaaggggaagagacaggagatcatattactgggtgactaacactaggtatgaaaattggtattgaagcattaatatcttaaactaaagtttaactgctttttttgctccccttgttttgttgaattgtttctatttagtttttttcccacctcatcgttcatctggccttttttctttttctttttttttcccaagagacagagttgcccaggctagaatgtaatggctaggtactgtcatagctcatggcagcgcccggttgctgggctccagcaatccccctgcctcagctactcgagtggctgggactacaggcatgtgccactgtgcctggccatcctgccatttataggagtcctttttcttttgtagaaatttcattgctattgactaacagggacaaacccattttttttcttttcttggagacagagtcttggtctgttgcccacgctggagtgcagtggcacgatcttgcctcactgcaatctccgcctcccaggttcaagcaattctcctgcctcagcctcccaagtagttggaactacaggcgtacaccgccatgcccggataattttttatattttagtagagatggggtttcaccatgttgcccaggctggtctggaactcctgaggtcaggcaatatgcccg

SEQ ID NO: 105745 - DNA, 237 bp, Homo sapiens
aacttccactcaagaacaacaatataatactcaatccccacaggatttactgcctcctgcaatgaggacgtgctaaacctctctccaaaaatgagactcacaaagccccatcggtcagtaacatcactctggataacggtggattctcttctcattcctcctctagctctagagatcacacccacacctcaatctactataatattcagatgaaaacataaatttgaccatcactag

SEQ ID NO: 105746 - DNA, 383 bp, Homo sapiens
cgtcccacgtacttcagcccctataaacatgcagaagccctccaatgatgcttgggaatagaaccatacagaggcatttcaataatgtaatcccactaagttatttaaatgccctgtcaactcccagcactccctgatgtcacctccctcaatcctccctcatgcactgtgacaacaccatggaagcctctccactcagccttcctgcagtcactttctcttgctcccttctccatcttaaatgttctaagaactctactctcagttttatatactccattctccctggatggcctcctccagtaccatagcttcagccatcagctatatttgggtaatgatcacatctccaacaccatctccatgtctccagcatcatctcc

SEQ ID NO: 105747 - DNA, 118 bp, Homo sapiens
gtcctatttgaaaactttatctccaaatagagtatttaaaactaatagttgcatttaggatctgctacaacttcctaagatttcttaaaacccacaaacctgctctgctggcttattt

SEQ ID NO: 105748 - DNA, 162 bp, Homo sapiens
ccacgttggcagaatggtcttgatctcctgacctcatgatccacccacctcggctcccaaagtgcagaaggaaggaactttttttttaaaaaaatgaaccttctgtgttcctgagttggataatttcaaacatatccacaagtagagcatgaaccagcagac

SEQ ID NO: 105749 - DNA, 880 bp, Homo sapiens
gaggtaaactgaggcagggaggggccctcccagagctggtaggtgaagattgtggcagggtggtgagtgggacccaatggtggaaggctgagtgcaggctggaggcagtgagcggtctgggtccccttcctgattcgagtttcattttggtaacgatgaaaggatgcctgtggtcctggccacctcccctgctctgcccctgggcccctgtgttctgggtgggccagccccctcccttccaggggcagcagctttgatcagagcctggagggggcggggcaggaggtaagggtttttgcacgctcacgtctgctgacactgacagctttgtcgcacggtggatcttgcttttccatttgggccagttaaccttgtgggggagaatgggggtggtgggacccttttcctcccagaaaaggtcagaggatgcagggggtgactggaaaatctgaagtgtctgctaggccaggtcaacgctgcctgtcccgcatgttaaagaattcaaaagattttttaaaatttgaaataaacattttagagtaggatacaaaatgcgcttgcatttctgggatcaaatactggacttcagaggcatctgtgccccggctggggcagaaggctgcaccttcctgctgctctgggactactgcccccaggtcccagctgcttatctgaaagatttcccgggtgctgctgggccttgtccaaggcctctgagcaggggaataatgcagcggacagggacgatcattccacggagtccctactgtgtgctgccctgggctacgagggggtaagacagaggacagtccctgccctgtgaagctgacacattctaagggagaggcagatgctaaagaattacacatatggctgggcc

SEQ ID NO: 105750 - DNA, 437 bp, Homo sapiens
gggtcacggacatgggctgtagcttgtaacatcgctcgtgctacagaaacaatggtcatgttttctgggactgcatcttaccttcttcactagctagggctctccctgggccaggcatccacctggatgagacatctttttaatccagtgtctcctagctcagtgccgtgaccacagccggtactgcatgaaagtttcagaatgaacgcaaacctctgttcaagagacttggaaccattttgttccaagattttccgaacgtgctttcaccacccagggtacgtgtgtcattgcagccctatgagcaggatgtggggggcaccttcatggatcaacagtgaacgtgcccccagtgctccatagatgatggagagcctggctgggaaagctcaagggacttgcccagggaggcagcgatgggccagtctctgttgcat

SEQ ID NO: 105751 - DNA, 792 bp, Homo sapiens
tgcctttctcctcccaccatgattgtgagaccttccccagccacgtggaacttctccagcctcccgagtagctgggattacaggtgcacgccaccaggcctggggaatttttctatattctgtagagacggggtttcgccacgttgcccaagctggtctggaaatcctgagctcaagcaatccgcccacctcggcctcccaaagtgctgggattacaggcgtgagccaccgcgcccggccgaattatttaagaagcgaatttcttagtctatgaaaatgacgttcaacggcaaatggcaaaatgaagttctgacttttccacctgtaaagtagattgatatgagcgggagtgagaagaccttgtcgctatcagtataagacaagagaactgagggcagccagttgtggccacagcaactctctgagtgaattgctgccacactgggcacagaagcgcacactctgaaatcgaatgtttggattcctttctacataattctactaaagagttattccacagcctaggggctgccttagagccccgtttgagacactctgggctcacagatcatgaagtcagtgcgcaaacgcgggcagaccctgaaccaggtgcccaacgcccagccctcacttccagagctcaggactctcgcaagagcgactccagccccggcctgccgctgtctacattcgcgctcttccttcctcgggaaacaaacggtggatcagatctccaaggctctgagtttcccagagtttggccgtgcgccagcgcagcgcagcccctcccag

SEQ ID NO: 105752 - DNA, 208 bp, Homo sapiens
agcaaggttgtactggaagaggccgagtctccatgcttgccacttcagagatccacgagccggcctgtcagagaaccctcgtctgctccaatgcagtccctcttcctcatcggggaatgtctggggaccgcatttgtatgcaggtgcacacacaggtggctcagagtgctgatgcaggggtgtgctgacgtgtacaagtcaaggatgg

SEQ ID NO: 105753 - DNA, 440 bp, Homo sapiens
aaaaattacttcaaaatatcagcagtaaaataatagacattgaaatgtaactcagtaacaattttagactgtatatttgaacagtagttcactcagaaagaagcacataggtagaaaaatgtgaaagattagttagttgagaaacatacagtttagagtccgggcatggaggctcacgcctgtaatcccagcactttgggaggccggggcgggtggatcacctgaggtcaggagtttgacaccagcctggccaaaatggtgaaaccctatctctactagaacttacaaaaattggctgggcgtggtggtgggtgcctgtagtcccagctactcaggaggctgaggcatgagaatcacttgaacccaggaggcagaagttgcagtgagccgagattgcaccactgcactccagcctgggcgacagagcaaggctctgttac

SEQ ID NO: 105754 - DNA, 260 bp, Homo sapiens
tgtagaaatgcccaaatctctgagaatacctcccatggtccctcagactccaatttggaatcactaaatctattccctggtgtgcagggcaggtgcaagaggaaaggtgggggtggggggcaaagaaggtgcagtgctaccaaaaagttaacaagaggaaaaagtcaaaagaccagacatcacaacagggaggtgagaggagaggggaccacggaaacaaggaagtgaaaagagctggaacctacgacagttaagaattt

SEQ ID NO: 105755 - DNA, 488 bp, Homo sapiens
gtgaggacagggctgctttgctctatcctccctgcaacttcagtgctgggcacaggactggctcttaatggatactgaatgaaccctgttatggactgaatgttcgcattctcccccacccccaaatgtatttgctgaagccctaatctccaatgtgatggtatcaggaggtggagccctcgaggggtaattagatttaggtgaggttgcgagggtggggccctcatgagtgcttttataagtagagaaagaagtaccagcgcttcctccctcatgcgaggatacggcaagaatgcatgtccataaggaagaaggcatgcaccagacatcaaatctgctggcgccttgatcttggtcttccagcctctagacctgtgagaaatgaatatctgttgttgaagcctcccagcctatgatggatttgttacagctggccaagctgacttagacaaatgagtgtgcctgatccatcccattgaatgtgacag

SEQ ID NO: 105756 - DNA, 768 bp, Homo sapiens
gccctcgcccattctaaaaagtcagcaccctcaggcccgcgggtaaccacctcctcctgagcacggtgaccaggtcaaaggctgtccctcgggcctcagtgttctcatctgtatgtcgagcactgcacagaatcagctcatgcgctgaggctttcactcctgtgatggaagagacagagaagggggtggcctctcctctccctggggacctgccattctcagcacaggcgcatggcaggcagcagcctcccttctgccagcagaggggcttaatgcaccctgctccatttgtaattcatgtgcggtgagctcactgggatgagtcagtttggatatatattcctccctgggtctgccccattttatggggtgttgcttaatcatttgcgttattccattgacatgaaatatttagcactcagagatcatttctggtcaggagaaatttgtgcatttttaacccaaaatagaaaccttcataaaagcatcataggtctccattcagtattgactataattgttcacatgcccacgctgaatgctaacttgggctcaccatcaacacccacgaggtgggtactattattatcactcacatttgaccagagggattgtttgattagggtgtagtagttgagagttcagacccaggagacagcctgcctgcttcaaatcctggcccaacccctggccctgtgtgaccttgggcaagtgactgcatctctctgtgctgttgttttcttattaataaaatggttgatataatga

SEQ ID NO: 105757 - DNA, 405 bp, Homo sapiens
ctgtatgacgctctaacagtgaagacatgccattctacatttgtgcaaactcacaggatgcacaacaccaagggtgagccctaatgtcaactcgggagtctgggagataatgtgtcaatgtaggttcatcgactttagcaaatgtaccaatctggtttgggatgtttatgatgatgggagataggggtggggcagggaatggccaagggttatatgggaaacctctatgctcaattctgctgtgaacataaaacggttctcaaataaaaagtttattaattttttaaaggatttttacacaactaagccttgataaacatttaccttctttcttcttcatcataattatttttccgcattattttgctattttccttctctccttctctctctctctttctttta

SEQ ID NO: 105758 - DNA, 461 bp, Homo sapiens
atgggacaattccagtcagtataaatcagctaagcatttagaaactattatcaggagcactagacagcactgcatgatcttctgcaaaccacaagtgatgtcaaagctgcaaggctgccgaactgccagggctgaagcaccaataatagatgctaaaattactgctgaagaagcatatttgattacaaagggcccctagagcagtaaagcacttggaagccttccctccgagttttacaagaaataagataagcagcatctccaactgtaatcacaaaatataataaaaaatgctccaggttctcatgagacatacaagtgtattttccttgaatgatttaaaaccattattttcctaacacacaacgagggacaaagttaccagtaaactgaggcaacctctagttggtaacacagacaactccatgaggagtttttgtttttgtttttcagtatgcttt

SEQ ID NO: 105759 - DNA, 165 bp, Homo sapiens
tgatgttagtgtcggcaaacctactgtgcttccagtcggataaaagcccagcacatacagtatacccagggaagccaaaacattggatacccctggactatactataatttttattgttattttagagcatattccttctgcttatatattaaaaagttacctgt

SEQ ID NO: 105760 - DNA, 218 bp, Homo sapiens
acaacactgtagatttcccactaattataaaatatgatgaagatgttggatggttggagagttaacttggccatggggcatgaatctatcataaataatctccagatgtcttgttcagctgtattttctgataaccaattatactgtaaaaaaaaaaaagagtggtataattaaatactggatatattgcctatcaaaataatattaatgatattggt

SEQ ID NO: 105761 - DNA, 298 bp, Homo sapiens
tggaggggtgtgggagagagacaaggagaggaggagaagaaaaacagacaccagggagagacagagatgggagagagatggagggtcacttgaggtacagggagctcggaccccccaactcttctggattccagggaaatggggatggaggtgccccaggcatgatccccagtccctggaatggctcagagctcactccccgcacctcccagttccacttcaatgtcccactgacaccttaaactcggctggtgtaaagcagagctcaccatcgcccccacacctccaactggctcct

SEQ ID NO: 105762 - DNA, 165 bp, Homo sapiens
cttggaatctccacctcccttccagcagaccatcaaaaggtcaggctcccccacccaacctggcaccccagattctgtcctttccatccatacccctaccatgactttagggtcatgactcgatttcactcttctgctgttttgcttccagggtgcccaatcctg

SEQ ID NO: 105763 - DNA, 676 bp, Homo sapiens
actaaacagagaggcatgggtttagaggaaggtggtgatgggaagatatagctgtcagatatctgggatttttttttctcttcctctctcagccagagaagcgtctccttttctctcccctcactccgaatcctgtaggatagacttgaaggtctattgaacctttactccaggattatccacaggctcacctgcccgcctaccggcaccttttctctacagctaggaaggcaggtctacttctattgctgagaagaagcaagatccagcagaaagaggagtctagcctggcccttttctattcctagctgaaaaacagctttcagtgggcaggtctctcactgtttcactgttacaaataaggctcagatctcaactgctgacacgcaacccaaacaggatgtgcagaccaattcacatggtttgagaccaccacatatttggagaacctgaggaattatgatgcaatccatttatttttctgtcctaaccatcacctttcatgcatgatattactaaacagtctctgaagtactagttcaacttgaatccctcccctggagaagaggtagtaaggggactctccttatggtcttgtctagatcaaccaaaccgattccagagtcactctggcatacagtagtagacgctccatacatatggatggcattatcag

SEQ ID NO: 105764 - DNA, 343 bp, Homo sapiens
tgagatggagtctcactgtgtgtccaggctggagtccagtggcacaatcttggctcactgcaaccaggagaactcaagaggttctcttgcctcagtctcctgagtagctgggactacaggtgcacgccaccacactcagctaatttttgtatttctagtacagatggggtttcaccatgttggctaggatggtctcaatctcttgaccttgtgatctgccggcgttggcctcccaaagtgctgggattacaggcatgagccaccgcgcccggcctaagctaattttgaaatgcagaaccgctttttgtggtttagtaaaattaactagcctttagttttaatt

SEQ ID NO: 105765 - DNA, 336 bp, Homo sapiens
aaatctcaatttgcatcctcatagagtatgtgtacacatgttttgaaaacactatagttggccgggcgcggtggctcacgcctgtaatcccagcactttgggaggccaaggcgggcggatcacaaggtcaggagatcgagaccatcctggctaacatggtgaaaccccatctctactaaatatacaaaaaattagccgggcgtggtggcgggcgcctgtagtcccagccatgggaggctgaggcaggagaatggcgtgaacctgggaggcggagcttgcagtgagccgagatcgcgccactgcactccagcctgggcgacagagtgagactcagtc

SEQ ID NO: 105766 - DNA, 377 bp, Homo sapiens
cgtggggctggccagctctgagggaaagggccctccttcctaattttcctgtcctctttcagctcctgaccagttgcagtcactctagtcaatgacatgaattttagcttttgtgggggactgtaagttgggcttgctattctggccctaatttttgttcacctctggtactgagaggtaaggtgggggtgggtgacattttcaaaggggctgtatccctaaatgagataagaccactcccttgtgggtggagacacccttagcccaaaggcttgagtagttgaagagctgtaaacagtggctaccaggtgccccaggtacccagacgatgagcaaagccccagcctgcggggggatacctcgtagagtcgaccagc

SEQ ID NO: 105767 - DNA, 966 bp, Homo sapiens
caggttcctttcgtaatacattgcgttctcacatacacttgtatctaattattctctgttttgtttcattgacttatcagtctactgttaacacctgtattgcattcttttaactattatgtcttgtacattttaatttattttattttattttttagagacggggtcttgctgtgttggccaggctggtctcaaactcctgacctcaagcaattctcccatctcagcctcccaaaatgctgggattacaggcataagccaccatgcctggcccctgtgcattttaatatgggtgacagcaggggtagggaaagcaatccccctcacccacaagacattagtctttttagtccttttttcggaattttcctggctgttctctttctttttatttatttatttatttttgagacaatctcactctgtcagccaggctagagtgcagtggcacaatctcagcttactgcaacctccgcctcctgggctcaagagatcctcctgcctcaggctcccgagtagctgggactataggcacgtaccaccacacctggctaatttttgtatttttagtacagatgggctttcaccacgttggccaggctggtctcaaactcctgagctcaagtgatctgcccccctcgcctcccaaagtgctgggattgcaggcgtgagccaccgtgcccagcttttctggctgttctcacgtttattcttctcattgagctttagattattttatcaattcctccaaaaggtcttattgagctataatccaatttgactgaatctatggattgatttacatagaaatgatgatttacatgtcagttcttagctttgaaagattttgtctgtacttattgtcatggttttatagtttttctatgtagacactatacatttcttaagttttctccccctgaacaattttgtttgtaattgttattgtgacagggctcttgcgtt

SEQ ID NO: 105768 - DNA, 163 bp, Homo sapiens
acactaggcagatcccatctcaagctcggggtcatcagcactaagtccacattcttgccttgagtccgtctgcttgttgctgtggtgatagacacagctgtgacagcaccgacatgcaatgtgtggaatttaatgtgagaaggctggtgaagcagccttgttg

SEQ ID NO: 105769 - DNA, 315 bp, Homo sapiens
agaaatactgtacaagatggtgactatatgtaataatatattgtaggctgggcgcggtggctcatgcctgtaatcccagcactttgggaggccaagtgctgggattacagggtgagccaccttgcctggccttcacttcacttatttttattttttttgagacagtgtattgctgtcgctcaggctcagtgcagtggtgcaatcatggatcactgtagcctggatctcccaggctcaacccacctcagcctccctaggagctaggactactaggattacaggtgtgcgcttaattttgtgtgcagctaattttgg

SEQ ID NO: 105770 - DNA, 333 bp, Homo sapiens
accagggagaataggccagggaggagagtgaaagaaatgcaggtctttggagtcctcccagactgggtagtggaagtccagctaggagctccagtgtgttgtccaaatccaggaagtaccattcccatagaataacacagtgtgcgtgatgctcagtagctgtactgactggtagtataagaaatcgataatactgcagtataatattataatacctgcccctagtagtaagaataactgttcttctccctgcttcacatatacctttaaaagtcctttgcagtgtcttcattttttttttttttttgcatgcctccactcttttgaagactt

SEQ ID NO: 105771 - DNA, 437 bp, Homo sapiens
aagggtcccctgggctttctttttgcctcattatcacagactgagtgccaaagaagcaggcatcccagaaatgccaatggtcatagaccaaaagattaaaaaaataaaaaaaataaataaaaagctccaagaaaaacctgttctctctaaccaaaagaccagaaaaggggcagcctagcaggacagaaactttagaaaataaccattctactgcagccaaacaccacgtaaaaaacctggggacccacctccacacatcagcaaaggccaagtggagagtctaaacttccgccacaccaggctgtagagagcacccaactcccctgccaaggtggcaacagagaacaaataggggaccaggactttcactcccaccaggaggtaacagagcctcctctacacagtgttattgggagctatgtggggaaccctgactt

SEQ ID NO: 105772 - DNA, 349 bp, Homo sapiens
cggccatgggggatggagccatcgactttggggtgaggcagggaaagggctcccagatggggtacctggattaggtccattcaagccgcgggtgaacgtgggcccgctccacccaagccgtggctgtgaggaggctggagagaggtgagggctcctgtcccctccctgcatggacacccttgggaagtggggcagctggggtcccagcctgggtctggaggggtcccacccacagcacaaataggctcgcaggccacccggacgccacgggctgcgtggaggagaactggagtgcatggaccctgctctcctccccggctgccaggagtgtccactgctttctaagtca

SEQ ID NO: 105773 - DNA, 254 bp, Homo sapiens
gcgtcatcgcgtcagccacgttttcagagcgtgcgttttccgcggggtgggagctgccgtctgaccataggtttcttgcggccctagattcttcggcgccttaaacctggggttccggaagctgtagcccccgtttcaaaatccgccggaagcgcctgacccccagaagtcgcgctctgccctgacctgccggagagcgggggccgcgcggagtttccgcgggacttcctgctgtggaggttaaagcacggttt

SEQ ID NO: 105774 - DNA, 299 bp, Homo sapiens
actcacgtcaaggaaatagctctccctttctaaaagagggtgatgcgggtttaagcaacaggtgagcagacactctgtcgcaggtaaggacgagtacctccaccttaaccaagacctgcccaaatgggcttcgggtggtgcccttcagccaatttctgtacaaagccttgtcataaatggctttggtgtagaggtagggaaacattttcttgttaccctcagcgtgtggaatgggagatggagaggcagaaatcaaatatgctgtctttagagctctttaagaacaggaaatgtgaaat

SEQ ID NO: 105775 - DNA, 500 bp, Homo sapiens
ttttaagcacaggcttaaaacctgagaagcactgtaaaaagtaacaaatatgtctgtgataatatttaataagcagatgttataaaaattaccataacattatataaaattatagtttactaaacaatgaaataacattaaattttgaaaaattaattcaaagtgaggtaaaagaaaaaatacacacattccctctcctctatcatttcagttatgtgcaaataaatctactaaccaactattaaaaagatcttggctcctttttctcagcctgcttaaaaatagtaacctgttttcagtaattcaggatagtggtcctggaaatggatgcctaatctgaatttaaaatttcaaaataatgtgcttttaaaaaagtaatagtaggctgggcgcggtgctcatgcctgtaatcccagcactttgggaggctgaggcgggcggatcacgaggtcaggagatcaaggtcatcctggctaacacggtgaaaccccgtctctact

SEQ ID NO: 105776 - DNA, 437 bp, Homo sapiens
tttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtgtgtgtattcggacagctatataaaattatttttagagacagggtttcacactgctggccaggctggagtgcaatgacaagatattagttctctgcagcctcgaactcctgggctcaagctctcctcccacttcagcctcctgagtagctaggaccataggcacatgccagtgtgccagcta

SEQ ID NO: 105777 - DNA, 408 bp, Homo sapiens
tttatttctagttgatttaggctatcatttaaaaaataaaacaggaagatgtcaaaattgatggtatgatttttcttatatcaatttctgtatgagttaagagtttaggttacctaattttgagacattcttgcgttcctgggatgaaaccctagtagatcatgatatgtcattctttattccattattaaatttattagctgatatttgatttaggacgtgtgtgtgtgtgcgtgtgcgcctgtgtgtgtgtgtgtgtgtattcggacagctatataaaattatttttagagacagggtttcacactgctggccaggctggagtgcaatgacaagatattagttctctgcagcccaggagtttgaggccaacctgggcaacatagggagaaccccatctctacaagg

SEQ ID NO: 105778 - DNA, 328 bp, Homo sapiens
cttcttcacaattaattgtaagacatttcttcccttattgaagggaaatcatcgtgtttaaagagcatttatgttgagttaagaaggtgacatttctttgacgtttgtatgcacataaaggtaacttgtagagagatctaagaacacagggagtgcaaatttataaaaaaaaaaacctttcacatgaaaagctacttgatatgtatcaaatatactcttggacttcataaggttattcattttagaacttgggttttctttctttctttttaatctcttaagattactggctacagtattatcttgcccagattcataacattctgtt

SEQ ID NO: 105779 - DNA, 243 bp, Homo sapiens
ttttataatcatgtgaatgttgtgctataattttttctattaggtgtaaaagtatttctcttctcatcttaatggaaagggggaaaagacaaaaacagtcttttggaaaacaccttaagtcttagtatctgagctttgtcttgtgttctgaatttagctttaccacaaactagaagtgtaattatgggcaagttaacctttcctagtgtaccaaatggtaccatttccccgccaataaataag

SEQ ID NO: 105780 - DNA, 775 bp, Homo sapiens
  misc_feature (40)..(40): n is a, c, g, or t
gaggtcactctagagcgatccctagctggtcgcagtccangacttgcggtgggctctgaagtgctagaacaggtgctacataccctaagcaagtcggggagcctcgaagagctggtgctggacaacgccgggcttaagacggactttgtccagaagctggccggggtgtttggggagaacgggagctgtgtgctgcatgccctcactctgtcccacaaccccatcgaggacaagggttttctcagtctgagccagcagctcctctgcttcccctctggcctcaccaaactgtgcctggccaagactgccatttcccctcgagggctccaggcactcggccagaccttcggggcaaacccagcatttgccagctcccttcgatacctggacctgagcaagaatcctgggctcctcgccacggatgaggccaatgccctctacagtttcctggcccaacccaacgccctggtgcacctggacctgtcaggaactgactgcgtcatcgacttgcttctcggtgccctgctccacggctgctgctcccacctcacctacctcaacctggctcgcaacagctgctcccacaggaagggtcgagaggccccgccggccttcaagcagttcttcagcagcgcctacacactgagccacgtcaatctgtcggccacaaagctgcccctggaggccctcagggcgctgcttcagggcctctccctcaacagtcacctcagtgacctgcacctggatctcagcagctgcgaggtgagccctcagt

SEQ ID NO: 105781 - DNA, 229 bp, Homo sapiens
cccgctctctgcccgccgatcggtaacccaaccgtcctgggcctgcggtccccacgcggcttccttccctcttcccgcttggcggtggagtctggccccagaagagggagctgaaaagggcagggcctccttattccagccccgcgatgactcatgccccgtatccattcccgctcccctcatttttacgtccgcaaactccccccacactcctgccacagagtttctg

SEQ ID NO: 105782 - DNA, 780 bp, Homo sapiens
caattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataac

SEQ ID NO: 105783 - DNA, 744 bp, Homo sapiens
atttcattttagattttctatttttgaaaactattattattttcacaggccagcaaggtggcttatgcctataatcccagcaacctgagaggcaaggcaggaggatcgtttcaggccaggagttcaagaccagcctgggcgatgtagcaagaccctgtctcaacaaaaaaaaaaacgttataaacttggccaggcatggtggcatgcagctgtagtcccagctactcaggaggctgaggcaggaggatcacttgagcccaggagtttgaggttgcagtgaaccatgatcataccattgtactccattctgggcaacaaagaaagaccctgtctcgaaagagaaaaagaggaggctgaggcacaagatttgcttgaacccgggaggcagaggttgcagtgagccgagatcatgtcactgcactccagcctgggtgacagagcgagactttgtctcaaaaaaaaaaaaaaaaaagtcaagggggccaggtgcagtggctcatgcctgtaatcccaacactttgggaggccaaggcaggaggatctcttgaggtcaagtgttcgagaccagcctggccaacatgatgaaacccgactctactaaaaaaatacaaaagttagccaggtgtcatggtgtgctcctgtagtcccagctactcgggaagctgaggcacgagaatcgcttgaaccccggaggtggaggctacagggagctgagatcacaccagtgcactccagcctgggcaa

SEQ ID NO: 105784 - DNA, 669 bp, Homo sapiens
cacctgaggtcaggagttcgagaccagcctggccaacatggtcaaatcccgtctcttctaaaaatacaaaaattagccggtgtgatgtacatgcctgtagtcccaggtactgcagtggctgagggaggagaatcgcttgaacctgaaaggcggaggttgcagtgagccaagatggcaccactgcactccagcctggcgacagggcaagattccatctcaaaaaaaaaagtgatttattttatttcttaatttttaaacatataatatgccttctaggtagttttgtgatttggaaaaccacaaaagaaaactgaaatgtttgatgccttccacaattttttagaaaaagaattctgcttcaaatagtgaaatacatttgtaagtgaatcagactctgggtagttttcattaatataaagtcagtttcctcccagctccactcacagatggtaggctcatatgaatctttctacaggcatcagatagtatgctagatgatggtgaaatggagatggaaaggctcatcccagctctcaagaactgactgtctattgaacaaagaggtaaacagatgattacagtatgtgaagataaatgcaccacggtgggtatgtgtattgggcaatgggaactcatagaagtgttaaatcaagtttagcctaaagctgc

SEQ ID NO: 105785 - DNA, 188 bp, Homo sapiens
tccgttgcctcaaagtttagaagtctgtcatttttcaaagatgtactacaattctgttttatgctggattttgctatggtttggtatttttatacgttgcacagtcctcctagagttaatatgaaatacgatgtcgagtgagttagtgtaatgctaagggccatgagctcttgacccagattgcctgg

SEQ ID NO: 105786 - DNA, 345 bp, Homo sapiens
cacatttatggacacttaatgttcctgcacacccataaataaggtgaagccgagtctgcatgtgtgcgaaagggcacagagctttgcacatacatggtgccagggtccatttcctggttttgtactatggttacgtaagatgtcaccactgggggaaactgtgaagatacatgtgatgttttttgctctgtgtgatttttgcaacttcctctgaatctgtaatgatttcaaaataaaggttgttttttttttttttttttttttttttttttttttttttttttttttttttttttttttttttttttttttgggtttttttttaagtgtttttttttttttttt

SEQ ID NO: 105787 - DNA, 208 bp, Homo sapiens
agctttcgcctacccactgtccacgagtcctggacttggtgtcacgggttccaagctgctgagactggcctctctgttgggtgagctgaggatctctgcgtccgttcgtgcttccccttctgtctccccaacccctgcgctcaccccgtaaccctcctgctgacacaccatgggagcacagtcaacatttgctgggtgaataagtcga

SEQ ID NO: 105788 - DNA, 680 bp, Homo sapiens
ctagcacccctgatgggccgtctctgcctcccccagttttgctccaccctaccctgctgtggcttgctattctgtcctcaggtcccctgaggtggaggcccagtttgtggagtcagcaatccttatctcctatacagagctgttgggctttttctttggtgagggggagggaagctccaaaggggagtgctcagggattgtgttggttactacgctgaacttggaccagcctggcccggaagttcccagaagtgtgggctgaagggggcctgcacggtcagctcaactccctttttgaaggtagctgggctactttacctaccagtttagtaggtaaagagagtttaggcctttaactttcccagagccacatagcaagttagttgcagaattggtacctattccagagactttgtagtcttctggagtcccagagctctgcctcctcagtgggcttttggccatctgagaaggaaggttcaattatagtttttggttcccggatacctgagggctggtactaagtctggatcttaatgggaaggggagaactgggcgcctcctatccctgtccagtgagagcatggctctgatttgggtaaactgtaaacaagaccagtgctgagagccacctccactctcagattaacaaaataaattaataagtagagcatccttcc

SEQ ID NO: 105789 - DNA, 216 bp, Homo sapiens
ttggatctagaaatggcttaagagtccaatggactttcatctactcacacgcagctctatctctggtcatgacctcatcagtacaagtcattttgcgaaatgatttgggaagttgattgtcttctccattaaaaaatacacatacacacacagatccatatctataatcttttatggtttaatagtgatgagtgttgctggtaactctcttgagca

SEQ ID NO: 105790 - DNA, 844 bp, Homo sapiens
  misc_feature (752)..(753): n is a, c, g, or t
  misc_feature (769)..(769): n is a, c, g, or t
  misc_feature (779)..(779): n is a, c, g, or t
  misc_feature (790)..(790): n is a, c, g, or t
tcaccctcgatggtgccctcgacctgtcctccctcagcaggcctgtggcatccagaccagttcgtggcccctaggaggggaaactgagtcccagccccagggtcctccctcggcttcactgggtgccccatggaggagacagccagggtgtgtcacctgacaggctcaccagaaccagcacagcagctgctgagttttggctcccggaccctggagcccctgctgccgaggctggggatggcggctccagaggtcattcctcccccggaagacacacgctggccttgggccaggggaccctcagcgacggggtcaccccaatgttctggaggctgcggttctgcttcctcctggggctgagctgagcaagctctagctctcgggccgagcgcaaggagggcaggagtgatgtctccaactgtgctgaggtctgccctgggtgcaagggccctgtgttttcagcgctgccgtgtggcccatggatgccccaggcccctggacagttgatgcctggggtccacactcctggacagggctctggacagttgatgcctggggtccacactcctggacagggctctggacagttgatgcctggggtccacactcctcgacagggctctggacagttgatgcctggggtccacactcctggacagggctctggacagttgatgcctggggttcacactcctggacaggcccctggacagttgatgcctggggtccacactcctggaccgggctctggnncagttgatgcctgggngcaactctgnaaggccccggnacgtgatccgggggtccagtcctggcaggccctggcaagtgtcctggggtccca

SEQ ID NO: 105791 - DNA, 356 bp, Homo sapiens
atccaaacttgtaaccactgtaaaacaaatcagaatttacgatagtggatattattaatagtgcagaatggatacccagatcttgcttcctttctagctaatgatgcaatgttggcctgaaatgcattacttatagccagggattttctcagcatcctgatgatatagcctcatttcgtgctaactctccacttctgcacatcttcccctaagtcctttactcatctttagaaagagctacttttggtgaaattttaaaaccaaggaatatcattctttatagaatcacacttctgtgttttccccttccccatttctgtctcgaaagcgacagactgctacataacctgtgaata

SEQ ID NO: 105792 - DNA, 357 bp, Homo sapiens
tgtgctgagtgtagggaagttaggaaggttcaagtcaagcagggctgtgtgggaacaaaatttagggttgaggacgagctgcaagactagaagattctggagacatgagcagccccacatgccaacacagctgtaggcagagtaaggctgggtactcagaaaggctataccagcagggtttgtcaaaaggttaagtaggaccagatagtcttagaaacccagatgaaaccttcttccaagggaaaattcttcagcggttatttatttatttccaggttgttttccacctttccaatggtgccaagttgcaacaaagtgaaaactagacctaaaaaaataattctcccattctaaact

SEQ ID NO: 105793 - DNA, 760 bp, Homo sapiens
atgaaacagtatcattttgggtgttacttataacacaaaagagagatgaaaaatctggaactgggatcacatggtcaaaggtgcagggttaatttcacagtacttgctgctaaattgtttctcccaaggactgcccctctgggggtttcccttttggaagggaacccatttcagcactccccactgcgctgagatctgtctgctctaaacaggcatcaaaaccagcaaccacagacagacgtggaagggatgttggccttagaaagccagcatgtggctgccatcctaacagcgactgaatctggggagaaccatcaaagcatgattttctaaaaccacaagtgacaatgttatagggacaggatatctacatgatctccaaatgcctcccctggatgacttattcagcacaaaggagaaagtgaagacacctggtagatgccaccctagtcaaatccccacagctcgcatcgccaggggacaaagcaagatcgcacacttcctggtgagatgcgtgccaaagactcgacatcacttcaataacacatcacctgaactcagttctgaggaaacagacaaacccaagctgaaggacattcgcaaaactactggcccttactcttcaaagacatcaatgttgtgaaagacaaagacaggaactgtttcaggtaagagattaaagaggcatgacagctaactgtaatgtcatactgggatgggaaacaatggccatgaggtcattactgggacaactggcaaa

SEQ ID NO: 105794 - DNA, 1303 bp, Homo sapiens
gcagcagtcttcaacatttggttgcaaatctccatccacatcaggaagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatctcccatgagatttgcttacttttgtatactgtattttccagcattacagaaccttggttattgttttttagccatagaatcttctagtaaaaaatatctgccaccattttagatttaagcatttgcctatggggagacactgaatatgtggatgtgtgtattaatatttggggtggggacagggaagggaatgtggaaaacaaatgctggctgtgagcagtgctgagatggccaggccaggcggctgagtttgcttggaaattcaggacattctgactcctaagagttgcccccacccaccatcaaactgaaatcagcaccaatggtgtcagcactttacagcccatagccaactttctttatttttaacgtagcacaaaaatgtataatagcaaggaaaagacatttttaaattccggttatttttattgtctaaaatgaaagcaacagtgttttgataaagatgaaaaagaaaagctactaaattagtaaatcagtggttacgtgccctgcagaatttcttaacagatggtgctgagtgcacgagttacataactttctctctaattgaggttcacaaggcgtcttctaaattttgctttgtacaattaattcatttctgatgttaaccaaatagagtgtatatatcctactcccattactgcctctttcccccctactatggcttgtagattttcaaaagataga

SEQ ID NO: 105795 - DNA, 454 bp, Homo sapiens
gtttgttatggcttgagctgagctttcgcttgccatccaccactgctgtttgccaccgtcgcagacccatcactgacttccacccctctggatccagcagggtgtctgctgcactcctgatccagcgaggtgcccattgccactcccaatcaggctaaaggctcgccattgttcctgcatggctaagtgcccaggttcgtcctagttgagctgaacactagtcgctgggttccatggttctcttccatgacccacggcttctaatagagctataacactcaccacatggtcccagattccattccttggaatccgtgaggccaagaaccccaggtcagagaacaagaggcttgccgccatcttggaaatggcccacgatcttgggagctctaagaacaaggaccaccccgccccggtaacattttggtgaccacgaagggacatccaaagtggt

SEQ ID NO: 105796 - DNA, 340 bp, Homo sapiens
gttgggggcaggctgggcaaactggagtgagcaaggcctacttatattttaatactttaaagttatttttattaaactgtctgctgtccaaacataatacatgttgtaggccaaaatggccatgaagctaccagtttgcaaaccctgaactgtgaaatcttttagccacttccctatcttctctgttggagccatcattagtacttaaaaaagtacctttgagtcagggagttctattctactctgtgtttgtgagaaatacggccctgcccctctgggccacagtttcctcatatgtaaaatggggccactcatgtccacttcccaaccccagtgcctt

SEQ ID NO: 105797 - DNA, 249 bp, Homo sapiens
tgagctcctacccgttatcgcggtacgttggggaagctaccagtttgcaaaccctgaactgtgaaatcttttagccacttccctatcttctctgttggagccatcattagtacttaaaaaagtacctttgagtcagggagttctattctactctgtgtttgtgagaaatacggccctgcccctctgggccacagtttcctcatatgtaaaatggggccactcatgtccacttcccaaccccagtgcctt

SEQ ID NO: 105798 - DNA, 675 bp, Homo sapiens
ttttttttaaaagatggagtctcaatccgtcgtccaaaaaaaaaaaaaaaaagagtcaagggccctgacagctaggaaggaaggcccaagaatgactagagaggaacagatgaacaaaatccccaggagatttgtccaccaggcccagggcctgaactttctttttctcaaacacagatgcaattccaggacaaaaacaaaaaacacttaagctctttccttaaccaggtcttctaggacacattccaggaatacgcatcgtggtcccctacagaacttgactctaaccatcttggcctgtgctggcacaggggtgacaatgggaaggcacagtggacaccctcaggagcgtaggggacatgcaggaggggccaacagaaacagtcctttcaaaaccacgcaatgcaatggctgccttgtcctaagggctaatcccaggaaaaggagcaggcagtgctgcccagcaggttctggaaaaccagcagccactcgctgatggtggcaatgtactccaagtccaagaggcttcatttgctcatctggttcctctgacccaggaacacatggaatggcttccacccacctccccactttgctctgatcccttcactgccagccctactccccggaagaggaaagagaaaggcaccacactcaacgctctatcaagaaggc

SEQ ID NO: 105799 - DNA, 309 bp, Homo sapiens
gaatctcaaaaggttggcactgctattcctgtttttacagaagaaaccgaagtacagagacatggagtagtctgatcttagtcacacagcacctatcatatcactctgtcagaacatggcgcactaggaggcagacacacacgcacattcgctgtctgttccctgccttgtcagggcacccaataatggtggctctctgtccccagcatggggcccaagatgagtcctcctttagcgagcagtgtcaatctggcatctctcaagcacgactttagaaaatgacggacagtgctcacgatcgatgaattc

SEQ ID NO: 105800 - DNA, 1461 bp, Homo sapiens
gaatctcaaaaggttggcactgctattcctgtttttacagaagaaaccgaagtacagagacatggagtagtctgatcttagtcacacagcacctatcatatcactctgtcagaacatggcgcactaggaggcagacacacacgcacattcgctgtctgttccctgccttgtcagggcacccaataatggtggctctctgtccccagcatggggcccaagatgagtcctcctttagtcagaggtgtgattctatccccagtcaccagggcttctaccacaaatgaaggacggtgaccaccctcaatgtcactgctgaactgggaaaccaggaaaagctatatgccttgtgggaacagcacataaaaaacatttcagatggacaggactggatgcagtgagtccatcctctccctccaagagctgaatggaatggttcaacctcaatggacctgagacgactctcttcaatgggtgaggccacttcatcactgtgcttcaacccagaaggatgaagctcattgttctgttcaagagttggccgggcgccgtggctcacgcctgtaatcccggcactttgagaggtcaaggcgggaagatcacttgatgtcaggagttcaaggccagcctgggcaacatggtgaaaccccatctctacaaaaaatacaaaaattagctgggcgtggtggtgcacacctgtagtcccagctactcgggagggctgaggcgggagaatcgcctgaaccccagagatggaggttgcagtgagccgagatcgtgcccctgtactccagcctgggcgacaaagtgagaatccgtcgtccaaaaaaaaaaaaaaaaagagtcaagggccctgacagctaggaaggaaggcccaagaatgactagagaggaacagatgaacaaaatccccaggagatttgtccaccaggcccagggcctgaactttctttttctcaaacacagatgcaattccaggacaaaaacaaaaaacacttaagctctttccttaaccaggtcttctaggacacattccaggaatacgcatcgtggtcccctacagaacttgactctaaccatcttggcctgtgctggcacaggggtgacaatgggaaggcacagtggacaccctcaggagcgtaggggacatgcaggaggggccaacagaaacagtcctttcaaaaccacgcaatgcaatggctgccttgtcctaagggctaatcccaggaaaaggagcaggcagtgctgcccagcaggttctggaaaaccagcagccactcgctgatggtggcaatgtactccaagtccaagaggcttcatttgctcatctggttcctctgacccaggaacacatggaatggcttccacccacctccccactttgctctgatcccttcactgccagccctactccccggaagaggaaagagaaaggcaccacactcaacgctctatcaagaaggc

SEQ ID NO: 105801 - DNA, 291 bp, Homo sapiens
tgagtggcagaagccattacgtggacccagtcttgtttccactctgcctttgcatagactatgccctctgcctggaatgctttacttattcatctggtaaaaggctactcactagaaagctgcttgggccaacacttatctgaagcctctccttcctttctacaattcatgagttcttcccttccacttctctgtttggcggtgatcatgtgtatttccgttctgtctctcccatcaaggacaggacctctgtctccctagccttgtcttgaatctccagcactcagcacg

SEQ ID NO: 105802 - DNA, 313 bp, Homo sapiens
tccttattatccatcattaatttagctaactacaacaaaagtataaatctgagtttaatacactcaaacacaacaactcatccataaggtttgttccccactctcctggcaaaactctttctttgtcctggtccaatatgaactggtaactctcaaagctgctgttcaatagtcattttgggattgtcctttgtcattatcccaataatcctctttgtcctgtttaatcttttcctgagttggaactcattttctgaatctcacattgttcttccatttactatctcatttagtgaagtatatacatacatcc

SEQ ID NO: 105803 - DNA, 336 bp, Homo sapiens
tgtagagatgtggtcttgctgtgttgccctggctggcaaaacttcatactttttgaccaacacctcctgattcctactccccgatccccagcctgtggtaatcattattctactcacaatttctctgagttggacttttttagattccatatataagtgagactgtatagtatttttctttctgtacctggcttatttcacttagcataatgtcctccagatttatccatactgttacaaatggtaggattttatcatgttcatattttaggaatggttgattataaaatgtttttataggtttgtttgaaaaccttttctaattattttatcatt

SEQ ID NO: 105804 - DNA, 201 bp, Homo sapiens
ggtaatgctgtcatgtaataggataataactgtttcttaaagatggttcaagctcccaagttggtattctgcagacataactgttctttgctgtttagaaataggggagtaactccagagttcattcctttgtatatgtatagtgttgttcattgtataaccttatttatttacctgaattgtcattatgtgtggttttac

SEQ ID NO: 105805 - DNA, 236 bp, Homo sapiens
cttggatttgaatcccagctatatcacttaagagttatgtgaactctgacaagttatttaatctctctgagccttgatttcatggtagtgaataccttatagggttaatatgaatattaaatattattttatgtatacatatatagtacaaagtatatgagcgtttaataaacattaattattattaatactatctcttatttattcagtaagcatttcttgagcaccaccgtgct

SEQ ID NO: 105806 - DNA, 793 bp, Homo sapiens
ttcaacctggcatgtaagcgtttgtctcctggtttttaagttttcattttttgcatcttggatatttccaagaattaaaaaaatccccaacttttcctttcgtttcagtctcctcacctccaggccacatttccatcaagtcttgtgttttctgtatattcccacactgtatcgtaactacttttccagttttcacagaagcagcttttccattggttggggcctctgcaggaggcttccccaggaaattgggatttctacaacaaattcatactcatatggtggtctttctgtgtagagtgcactgtggattcattctttcattttactcatggatccatgctgttaaattcacctattttaaaaatctcaaccatttttctaagaactagctgggtgcagtggctcacacctgtaatcccaacactttgggaggcagaggcaggaggatcacttgaaaccaggagttcaagaccttagcctagtcaacatactaagaccccatctctaccaaaaaatgttttaaaaccaagcaaggcatggtggcacatgctttcagccccagctagttgggaggctgaggcaggaggatcacttgagcccaggagtttgaggctgcagtgagctatgaccgagccaccacactccagcctgggtaacagtgagagaccctgtctctgaaagaaaaaaacaaaaaacaaaaaactatgcttttccatgtgtgcttcccttccatcacaagcactgcagccagtttgttgtggttgttttttagccttttgctccttgtccc

SEQ ID NO: 105807 - DNA, 690 bp, Homo sapiens
tctattcccagatgacattttaaaatttcttttctctcccatctccactttttaaaataaaccttctttttaattaagtctagtgctatgtctctcatatttggtaaattagtgtgtgtaattaactcatgttaataggtagatcaaggaagaattcagagaggagttgagaaatcatcagtcttttaactgatgagtttgtcaagtgatagaaaaagttaattgccttgtaggcaaatagaattctgtgtgcaaaatgcgtggaagcatgacattgggagttattctgcaaaaaatagcatttgcatttttgataggaagaaacagatagcacagagatttgggcaaaatcaataaaatttgttaattgaatgcaagagaaggaaaaatcaggatgactcctaggtttctggttagagtgactagctgaaggatgccatcagttgtgaggaatgtccttcttgaatctgaactgtcattttaggtaaggcattagtaattgaatatgtttctggctttgcttaatcatatgcaagattggaaagagttaaaacacttttaatgttaatcatatctttaccactgatttgtaaaatttcatcaagccactttaatttctgtctaggtattagttctgggcattagagaaacatagataaatactccctaccattgaagttcttatatgtg

SEQ ID NO: 105808 - DNA, 417 bp, Homo sapiens
gctagaaagggcctgggaggcggggctggaccttcctgcaagtcgcagctccacccctcactaactgttggccctcagcaagccgcgagctcaccgcaccccagactctagacccgtgcagtgggaaggatgacaacacccacttcactgagcccaccgcggctcagagggtggcatgctcccgccccaacaaagcagggggctgcacctccaggggctgtccctctgggcaccccactcctgggtagcaacttgaaagaggaggtctcggctgggcgcagtggctcacgcctgtaatctcagcactttgggaggccgaggcaggcggatcacaaggtcaggagatcgagaccatcttggctagcacggtgaaaccctgtctctactaaaaaatacaaaaaattagctgggcgtggt

SEQ ID NO: 105809 - DNA, 299 bp, Homo sapiens
ccagtagtgttatggggtggaaggaatcagcatcgagagttgctacgttatctaaatcgtccagttttcaacaataataacaaaaaaaaactatgaggcatataaggaaacagaagactgagaccaataaacagaaaaacacgcaacagtggccaggcgctgtggctcatgcctgtaatcctaacactctgggaggccgatgcaggtggatcacctgaggtcaggagttcatgaccagcctgaccaatatggtgaaaccccatctctactaaaaatacaaaaattagccgggcgtggcg

SEQ ID NO: 105810 - DNA, 312 bp, Homo sapiens
tccttattgacttaaccttgtgtagggtcacttcttcaaccccttgcccaaagctactttgcttttcacctaaatttttatgtcatattcagcaacgacagagtttcataaattatattagttgtattaaactcattattaaaaatcattgtgaatgcccacatggatggattataagccaccaattaaatcttcaatggacacaaaaacctaaggatgttgggaaaataaaagtatatatacttggatgattaaaagagagattgatatggctggagaggtaaattagggtcaaatgcaagatggctatat

SEQ ID NO: 105811 - DNA, 392 bp, Homo sapiens
atgtttttctatgaagtcaccgcaaacactggattatcaaatattgaaccagagctcctgtggaaagtgtagggtaagattcccacaagcctctgatcacaactttctcatcaaccagttaatgtgtaactgttttgcatgtttctgtttaaagacacctacttaatagatattgttaattcattgacatttgtcaatcaaatcaaaattaagtttataatttacaaactcaaggccaaagcactgtaactgatacctgaacaaagcttatctaatacacatactttctcaggaaggtgcatcctagcttcctggcacttaggaacacactagagagcactttaccactacacgtggggaccattttaaacagcaaaatcacacacacgcac

SEQ ID NO: 105812 - DNA, 367 bp, Homo sapiens
tgctgatgaaactgtcagggcctttgatagtatagggaaccaagagttgtgagagcagtaatggctctatgtaaagagagcagaagtaaaagatgcagaaagggcagcagcaattacttgtagaggttgttaataaattgcctatgaacaagtcatttgttcttgaaatgtggtaataatgctttttataggccaagttttaaaagcttaagttgtttttaaatacttggtggccgggcatggtagctcatgcctgtaatcccagcactttgggagaccaaggtgggcagattgcttgagcccaggagtttgagaccagcctgggcaacacagggagaccctgtctctacaaaaaatacaaaaagta

SEQ ID NO: 105813 - DNA, 560 bp, Homo sapiens
ctctctcaagaaaagtgccaaggcactcttaattggaggaaacagctaaacagaagagcaaaattaaatagtaaatggaatttgttatacagatcaacaaatgattttatttgtatcattaattcaagaggctttgtttcttagcatcatcaccacgtagttcctaacccaatgaagttgcaagacatcattttcttaagccctgaaattgttttaactagtctctaaatgtgaaatctttggcatatttcacattaaatttgaacagaagtacagtctactacactcgtataagtcaatgtcctaagttcatatcaattgatatatttttatgaaaaacataacacatatagtgttagtaaagaatagactagagaaaatggtgcattaaataacttctattttatgttacaaaatatatgaaaaactgaaggtatgagagccaattgagtgttaccaatataatgtcagctccttttcctacatatgaaagaaaattccattatattggtaacactcaattggctttcatacgtaggaaaaggagctgacattaatat

SEQ ID NO: 105814 - DNA, 944 bp, Homo sapiens
tgtgactgaactgctgcaacctcatgataaaagttgaacaaacgaggagttgcttcttatggatgagcaaagaaagtggtttcttgagatggaatctactcctggtgaagatgctgtggacattgttgaaatgacaacaaaggatttagactattgcataaatttagttgataaagcaatggcagggtttgagaggattggctccaattttgaaagacattctgccgtgggtaaaatgctatcaaacattggatgctacagagaaatctttcatgaaaggaagagtcaattgatggcacagacttcattattgtcttgttttaagaaattgccacagtaactcagccttcatcaaccactaccttgatcagtcagcagccataatattgaatcaaaaccttccaccagcaaaaagatgactcactgaaggctcatatgattatcatttttgttagcaataaaatattttttcattaaggtacgtacattgttctttcagacataatgctattatatacttaatagactgcagtataatagtgtaaacataacttttatatgcactgggaaaccagaaaatatgtgtgccttgctttattgtgatattcgctttattgtggtggtctggaaccaacccttcagtatgtctgaggtctgcctgtgaaccatgctaggccaaacaaaaaaaaaaaaggagatctgggcttgaggaggggcaggcaagttttgggagggtgactaggaaaagtgataaacaaggattgttgagtaaaatttgttttgcagattgagcctctctattgagagttgttagggagtcctcaccctgctacagcaggatacatcttttacaactgggagctttgtttacaaggaaaacttgcaccctgtttttagagcatttcctgcatctgcttgttctcagtggtctttagctcaaaata

SEQ ID NO: 105815 - DNA, 204 bp, Homo sapiens
acaagtttaaagaaaatgtacttgggattaataatggctccctagagatcagtgtggatgcaaaactatgatatgagcagcacgtttgctgaaattattttatgtggtctgaataagaggtgagcaggaatgaagcttgccaattagggcagacaccattccatgcaaacttagctggagtgattgtccaaagtggggaggaat

SEQ ID NO: 105816 - DNA, 650 bp, Homo sapiens
gagaataaagatttttccatttggatgttctaatgggggttcccagtacaatctttccaaaatggagagaaaaagcaaggaaaagccaaagacagcaagagtttcccagagcacagagccaggaagaggccaaaatgagctggccccagctgccagcccacagggagggtgtccagaacaccttgtccaaaagctcagcccagataaatggtcaaccccgcgtgggatctgctcaccagctctgaaggcggcccttggctgtggacataatcttctttccatttcttacattacatcagcagaaccactagcaagtagaatagaaatcccaactctcttttttcatgcctccagcctccttcatcactagttccaccaacacccctacaccctgaagtggaagttctaatcacaggttcgacacgaggccaagcaaattagctcggtagtacagacccaaaagtcaggtcaggagaacagcaattgtgtcagctctgaacatgcacatgcgaaggattctttcaggggatgctccgccttctctgacggagagcatatgctattccagtcactgagctcttgctctgtgcctggcagtgttttgagtgtttctgttttacgttaattaacccgtgccatcctcatcacca

SEQ ID NO: 105817 - DNA, 286 bp, Homo sapiens
atccgcctgcctcagcttcccaaagtgctgggattacaggtgtgagccaccacgcccggccccagcccaggaagttttgtggggaattttcctgacatggaatgactctagactgccgccgctgccgacaacaataacaaagtagataaagcctactggtatggcactcaactctttatgccgttggtcctcactgcagtcctgacgtagctaccattgttatctgcattttgtagaaagggacactaagggccatagagtattaagggacttgcccctaggttat

SEQ ID NO: 105818 - DNA, 281 bp, Homo sapiens
cataagaggtgagaggagtgggagtctattttagaaagataagatgccaaaaagaataaagtagctagtatttgaccacttactacgtgtcagacgctgttgagtgtattatttgcattgtctcaaactgaggcttagaaaagttaagtaacttgcccaaaatcgtaaagctgataaatgacagaggcaagaattaaacccagatctgtgacagcaaattccattttctaagtcacttcagtaaattgcctttctttgaatggaatcaggagattactttt

SEQ ID NO: 105819 - DNA, 200 bp, Homo sapiens
gattctaaaggaatgtctcaggatgtcaaggaaaagaaggggctccctatctttaactagaacatatgaaatgatacagaaaaaatggaaaataataaaaaaagaacccttgagaattaaatcttatctgacaatatccaatcagaataccactcatcatctctaccagtcctctctatgacaatgtagcatggttgtga

SEQ ID NO: 105820 - DNA, 507 bp, Homo sapiens
gtagacgacggggtttcgccattttgcccaggctggcctcgattctcccacctcagcctcccaaaatgctgggattataggggtgagccactgcacccgacctatatatacatttctaggtcctcattttctagaagtagttccaatctttttaccatcctagctctcaaatatttaaagattttatctactaagtaaacattcattttttcctgtatcctatttattagttatacaaatgcaaatagaggctcagaagcaccaggcaattaaagggttgcagcaaaacataaggaagaaatggggccaggcgcaatggctcatgcctgtaataccagcgctttgggaggccgaggcgggcagatcgcgaggtcaggagtttaagaccagcctggacaacatggtgaaaccccgtctctactaaaaacacaaaaagttagctggtcatggtggcacatgcctgtaattccagctactcgggaggctgaggcaggaaaatcgcttgaa

SEQ ID NO: 105821 - DNA, 256 bp, Homo sapiens
tgagatggagtttttaaatatattctggataataaccctttatcagatatatgagtttcaagtattttctcccatttcatggttgctgtttcactttattattagtgttctttgatgcacaaaagtttttattttgatgtcatgcaatttatctatttttaatgcaatacattttttaaaacaagaattaattcaaaaaccgtgatgaacaaaacatccaaattttaaatacagatagatcggtattactgatttt

SEQ ID NO: 105822 - DNA, 215 bp, Homo sapiens
tcatccctgcacatggctataactcccgaggaaggattgttcccagaggacgtcggtagcctgctgagaccctgcctagaggaggaaggggaggaaggcagtagattaatcaggttttacatattccgccttttatgatgctttgacaacttggggccttgctggtcctggaggggctgccccttcccaggccagctgattcctcgagacagcaa

SEQ ID NO: 105823 - DNA, 449 bp, Homo sapiens
cccatgtgttgtgggagggaatcagtgggagataattgaatcatgggggcggttacccccatacagttcttgtggtagtgaataagtctcatgagatctgttggttttataaggggtttctgctttcacttggctctcattctccctgcctgccgccatgtaagacctgccttccgccatgattgtgaggccttcccagccacctggaactgtgagtccattaaacctctttttctttataaattacccagtctcaggaatgtctttgttaccactgatttctattttttaaactggaaaatgcacatgacatcacttatttctccctatataaaaacccatgatgaggtacttagaggtaccagaaatcacagagacagaaagcagaatggtggttgtcagcagctggagggaggtggaaatggggagttctagtttaatgggtacat

SEQ ID NO: 105824 - DNA, 389 bp, Homo sapiens
gacctcccactgcaggaagctggttttggaggagggaaaccagcttttgctgggaaatcatcaagaggaagtaatacttagagaaaggaaagaagggtagcaggaaccagagctaagcctagcagaacgggggcaggatgaggctgcaggttgggggtgggggcagcccagagcctccacctccccacacagaaaagcttgatcagccctggcccagctccagacaccaagcctgggatcagcaatcctgggagagcccccaaacttgccaaaatttcccctgctcctggactctgctcttcctgtgataagacccattttccgggaagatgtgatcacaggacactctgcctgtgagtgtctgataggaggattccatctgagtcctc

SEQ ID NO: 105825 - DNA, 372 bp, Homo sapiens
aacagaccacccatagattacaccaaaaaatatacttgtatgatgtgacatatatattgagctttatatttatgtccatacaattggccctccgcatcctggggttccctactctcagtttcaaccaattgcagattgaaaataattgggggagaaaacaaaaaataataatgcagcaataaaaatgatacaaatttaaaaatatacaggataacaactatttacatagcatttacattgtattaggtattataagcaatctagagatgatttaaagtatacaggaggatttaaagtatacagtaggttatatgcaaatactatgccattttatattagggacatgagcatatttgaattttggtacccatg

SEQ ID NO: 105826 - DNA, 243 bp, Homo sapiens
aaaaagttcatcgtatggattgacactgggctgctccctggtggagtaccagctcaagatgttttgaggaaaaaatttgcatttaccaagtgggaggatttatagtggtgatttcacttgttcattgatttagacatatgaaatattatattttttgcacaactaagttggctttcagattatatgaccatatttttaactaaatgaagctttgctgaataaatacatgacttaatatattcc

SEQ ID NO: 105827 - DNA, 305 bp, Homo sapiens
aaaaaagactcaggaaaatggagagaccaggaaagtggcttaaaaatagaaatggagtcaaaatcagaagtagcacagtggagactagatactgatgagaatacagaaagaaacatagaagttagcaataagaaaagcaagcaaaattaacgaaagtaaatagaatttaaaacaattagagatagataaaatgtaaataagtagggaagacaggcaaaggaaatccaatatacagttattcaaaatctctatgtaatgaattagaaaaagtatttgaaatactgtggaagaaaatgttcattttg

SEQ ID NO: 105828 - DNA, 630 bp, Homo sapiens
tctggctgctgtccctgtcttcatagaatttaaaggaagtccttctgaaccacacaggcttccagattgggctggcttggcctcatcagctcattcagcttatgattctcttagaggagaaatgagttacctattttaggcattaggaacttcatgcttccacaaggagcagcagtgttgacagactaggctagaaagaggaaagggatagagccttagatacactcatgcattcctgccctggcttgctttcatggcaacacagaaagcaatattcaggttgcaaagcatgtacttgaatacagttagattagcagcattgaatggagaataagcttgccgctatctggctagggaactataggattaaactaatggtatgcaaactaatggttataaaactaatggtatgtaggggaattctccctctctcttcctctccaccacaaacacacacacacacacacacacacacccacccacacacacaccgaatcttaattatatgtttactgtgagggaaaaaaggctactcaatgaatgcttaattagcagtgatattcctcttctctgtgcggacaccaactgtgaaataagacccaagcatgtcctgtcaagccaagaagcttt

SEQ ID NO: 105829 - DNA, 338 bp, Homo sapiens
gcagtgcacaatcacgacccactgcagctttgaactcctgggctcaaaggatcaagggatcctccaagttcagcctcctaagtagatggaactacaggcatgcaccaccatgccctgctaatttttaaattttttatagagatagggtcttgctgtgttgcccaggatggtctcaaattcctggactcaaacagttctccagccttggcctcccaaagtgctaggattataggcatgataaatcattttttaaagcatctagatcaagcattgactagcaatatgaatgaaatataataatctcaagattaatcaataactttgcaaatttctatagt

SEQ ID NO: 105830 - DNA, 257 bp, Homo sapiens
ctagtaatttttatttctccttgaatattcaagagagaactaagcactacatgtaaatcgggaaacaaattggggtaaggaaagaaacacatgaaagaattagagggagcagtctaaattctcacagaacaggaaaaatagctgttcctcccagccacattagaaaaactgttagttcacagggtatagagtatctagaagagccttgttcggtaccaaggaatacttattcctatactatgcactgtttttggcta

SEQ ID NO: 105831 - DNA, 462 bp, Homo sapiens
aaaaacaaaaatgagtattttcaacttgtttctcttcctagcctccttttaaacaatgatttacttcatttgctcaatcattatgaataaaaatgatggcattttccgtgctgcaagaatttctttaaaattccgatttttggtgaaattgcattgtgtagaattttcttggtgtgcatgagggcagtttttgtatgcagaaaaggtttacgataatcttaaaaataaaattttatttcagaaacctggttcttgaggatttaagtccagtttttaaattttgtttacaggtctagctattttgagttataattgccagtaacttacgcattttccagcaatttaagctgtgtttaacacatgctttccttaatttgagtccaaagttctcttaggtgtttcagcatttagcaagatttcaactttttaaaagagcctaaattaattactgacatttacttt

SEQ ID NO: 105832 - DNA, 319 bp, Homo sapiens
tgcaacttctgcctccctggttcaagtgattctcatgcctcagcctcccaagtagctgggattataggcagccaccaccaggcccagctaatttttgtatttttggtagagacagggtttcaccatgttgaccaggctggtctcaaactcctgatctcagtgatccacctaccttggcctcccaaagtgctgggattacaggtgtgagccaccgtgcccagcctatttactcatatatttacaaaacaaaattaaacatctgaccctctcaagattgacaactactcagtacactgatttatggacttttaatcacaac

SEQ ID NO: 105833 - DNA, 451 bp, Homo sapiens
ccccaggtattacaagtggaggctggggactaccactgtcagttcattgtcaactatgtccgcctcatagacagggcacaagcctatccttagggacacacgtgaagaggggaggcaggaagattcaggcgcgctctccggcctagactggctgaaggagggagattttaatgcttggcataggtggtgaggggtccaccaaaggtaggaacacatccctggggctctgggaggaagaagcgtcaggactgcagctccagcctcttcaggcccagggtcctagggtggaacaaggctggaaaactggtgcatggaggaaagaaaaaaaatgggaagggagaatggacaggtaggaaggaaggaaaggaggaaagggaaatggaggaagaaagacatggaaagctgggaggacagagggcaaggcagaaggtaaaggaggcaaggccaaggc

SEQ ID NO: 105834 - DNA, 151 bp, Homo sapiens
catggtcatcgttttatacctgagtcgaaagtaccagatacggggacactggtacccacctgagctgcaagcccgcacctgcgtggatgagtacttggcgtggaagcatgtcaccatccagctgcctgccaccaatgtctacctgtgcaag

SEQ ID NO: 105835 - DNA, 305 bp, Homo sapiens
aggtgttcatcttccagttcgtcaacttctactcctcacccgtctacattgccttcttcaagggcaggtttgtgggatacccaggcaactaccacaccttgtttggagtccgcaatgaggaggtgagtgtgcctgaggcccgggactgggggatgagctgtgtgcttcctctcacttccattcttccattcgagctttgatttgcagcaattcctcccaccaccggctatttccatcgcccagccagggccagctgtgcagctgaccactcagggctcccagcctctcttcaccacttattctga

SEQ ID NO: 105836 - DNA, 396 bp, Homo sapiens
ttcttagttgcagaattgcacactgtggaaatgactttactggtaaaccctgggtagctgtacatctctctatgagaaagagttttataggaagagacatctatcgccaatgaattgccaaaagaatgatttttcctgaaaatagtagaatgtcttttctgtttgcctccacatttgtcatgtatctgtgaagtatgtatacagacacacatgcgcacacgcacatgctgcatgtatgttgaaaaacattaatttttaaaaatttaaaaaattttatagagatggggttttgctttgttgtgcaggctgttctgaaactcctggccttaagcagttctcctgagttggccttccaaagttctgggattacagatatgaactatcatgcccagccaa

SEQ ID NO: 105837 - DNA, 812 bp, Homo sapiens
atgattccatttatataagagttttgcaatggcaacattttaatgagggacaattttgtgtctgtaaagtgttaggcacaggcgtaggcagggagggaggctgctgtagttataaaagagcaacatgaggaatgcttgtggtgacgatactgttctatatcttgactgtggtgaggaatacatgaacctacagatgataaacttgtatagaattaaatacacacacatgcacacccacacacgcaagtcaaatgaaattcaaagatgttataaagttttaaatacagatgtgatgtgattggacttgtgttttttaaaaaaggatcactgagacttctgatctatacaagatggccagattagatattggacctgaacatttttctttgttcttcttccctaagtacaactatacatcccagacataatgtgagaggcaaccagcagaggactctgaaaggtgctaagaggaaggcagactggtttctggcatcaggaccagagaagcagcatggggcagggtatcttatgtttcccccagccagtaaaagaaggtgatcaggaccagcattttacaacctgtgacctagcaacagaaggtggttcaggaaagctccttcttttcatggagtccatccagtgtcaacagggaagcccagcaccattggcaaagggatcagtcgggaattcagttatggctagccatacatgggcagggtaaatgctcttcttcctgaccaggcctgggacttctccctctaccaagagatacaacacagggtcaccaggttgtaccagcaaaagggggccca

SEQ ID NO: 105838 - DNA, 1013 bp, Homo sapiens
ggagagagagagagggaaagactgccttctagaaatttggtgtgagccagacccccgctatcctagtgtcatttgcacaccagggctggaaggaggagcaggtgtgggtggggtggtcaagagctcgttccaggtggctctgagcatcccaggagaaagggggaggcagactcaggtactgggtcctggaactcggggaacggtctggacagacatgcgaggacttgtgtatcctgcagagggcttagcttttgcgctggaggctgtggagacagtgtcacaagtgggaatggcaggatctgatctgggatttaaaagcctccctctggcagccaaaagcctgttgtagacttgtctctgtaatctgggctatggggattgagggggaggtcggggaggtctaggagaaggcagaggtaggcttaagccatgggctgcagaggggcaccgctgtccgctgcctcgctggggagactgtgctactgtcggctgggatgagcctacaggagccctcagttcttgtgccaaggccaggaagtgctagactggacgagggttttggtttatacttgtcattcaggagccaatgccaaatcctacctaaaatccaaaccatcctacctaaaaaaccaaacaagaacaaatgatctagtgcttcctgacttttggtgacagagatccccacgtggcagctgcacagtcagtgtcaccagctgtgctcaagagctgggcaccttcagagttgtaaaaccagagccaacatgcccgggctccagcccaccaccttcttcccacagcgggtattgacacagtgagactgagcttggacacgggtgggatcgtgcagagttgccaggtagccagacccaccctgtgattcttcagctgcgccgcttgcccaaggcaccacgtgaggccaccagtttcactcagttcaggtctgcccagggtggtggccagactggagactcctcccacggcagaaaggcattcccacctggctggaaactgcc

SEQ ID NO: 105839 - DNA, 230 bp, Homo sapiens
tttgagtctcaaactggccttttcctttgcaaaacagaatgatccaaagtcacggtttctttaaagaactgtaagaatggagtctctagggaaaatgtggccggttagtggattacagccatagtggaggattcccttggtaatccaggttttcacttagaggaattagttaaaataagagatttgtgacatttggagctcactgttcagaataaatgtaaacagttatg

SEQ ID NO: 105840 - DNA, 91 bp, Homo sapiens
caagaacctagacaactgacggttgagaccttccacccagtaactctgtgcctcaaaggggcactgggaatgaagtccgaatatgctatgg

SEQ ID NO: 105841 - DNA, 485 bp, Homo sapiens
  misc_feature (394)..(394): n is a, c, g, or t
aaatcggaggtgctagggagacctcagctgatctgagaatcaacaaaaaatctactggcctgctaaattcaaaagatatgcattaaaatactgtcattaggcaaaataattcatggtttctatcatcaccctcacacacacagaacaatgaaaaccacaagctccactgatccatacatattacatgtcataaattgaaatagtgctgctgttcatgtgaattatgatgacgtctttgggccacatggtatccattcagcctccaacagtccatagactagaggtcagccatgtgggcagtcaaacatagagttccagtaaaatctctgggaaactaaagttctgaggagcctcctcggttgggcaatattctatggcatattgtcacacattngatgtcaggagggtaatgcatcctgaaaataatagaagcctcacatttgaaacacccacacccccacttcattgaactccaccctgtgcat

SEQ ID NO: 105842 - DNA, 364 bp, Homo sapiens
tgtgaggtaagcagtaagtggaattttgggaaccaagtcaagaggggaataatcaagcatcaaatgatgtcaacaggtctagataagaactgaaaacagacaatgcacctgatgacatggggttcactgagctttataagcagttccagtggagcggtaaagatgaaagtagattcaaaaataattcatgttatcttgcatggatggattcactcatctcccctctcttctccctcccaccaatgcctatccctgatcctatctcagcttagagtgaaactgtaaaatgacaatgtctcatgtaaagctctatgtagaacaagtcacttatgtctttcctgaacaagtatgaaatctttttaat

SEQ ID NO: 105843 - DNA, 665 bp, Homo sapiens
acactggtgaggctcttcctgtcacacgtgtcccagctatgtgcccatgtgctcctattacaaaaagataggaggccggacacggtggctcacgcctgtaatctcagcactttgggaggctgaggcgggaggatcacttgagcccaggagttcaagaccagcctgggaaacatagcaagaccccatctctacaaaaaaatacaaaaactagctgggtgtgacggcatgtgcctgtggtcccagctactcaggaggatgaggcagggtgattgcttgagcctggcagcttgaggctgtgcccttttgttgtagaactccagccagggtgggggacagagtgagaccctatcttgaaaagacaggaaacaatctaaatgccatcaatgggagatgacttagatgaatcaaaactcatcaattcaagagtgttctaggctgcccttccgcccccgcccccccacatgattctgcgtaggctcctttgcacgtttggccatttaaaattgctggcattctagtgtttttgacctttagagatggcagtttttataaggtccaagctcataatgaggaggtagatgtttgctttgtgctaatatgagaaaagacattaagcagaaaaaaagcaaaatgtgatacagtatgtactgattgagatctttttt

SEQ ID NO: 105844 - DNA, 316 bp, Homo sapiens
atagcacatacagttttctaggtattataacctaagactgttagatataaggtcatatactttaaaagtacaacgtaactctttttcccatccctgattcttttctgagtattctggagacagggaggggggggtcaaatgtgtacccagaaatacagtgacaggatggacctcatacctcatagccagtgctactcagccagccagtgagacatgcctcagtggctctcaaataccaatcttctcagctagcagatggaagagatcactctgcctgctcccttagtgataagggcaggaacccccccgcactgtt

SEQ ID NO: 105845 - DNA, 156 bp, Homo sapiens
ctcatgtttttaatttctcacctcaatctcatccaaagggcatgtataagttgaaatgtattgataaaagaacatcctgcataagtttctattactagtaactctagcaaatattatgaaaaaggacgttgaaaattattcagtaaagttacaaga

SEQ ID NO: 105846 - DNA, 702 bp, Homo sapiens
gattcacatttattatagttgtcatttattgagccctgcctaaataccagtccctgtcctagatgtcttatatatcttctctgtaactcctaccaccaccctgtaggaaggtattatccccattttaaaatgaaacagaggctgaggggaatcaaataacttgccagctgctacagaattagtcctgaagagcagagttctatacctaccttttcttagctctttacattgaccagaaagaaacaaaaatgaatggcctgatgctgaaaagagcaaatcagggttctatttctccagtgtaatggacagtagtttgttaattgaagtgagttcctatgccttaaataaaaatatgtaatataaaaataggtactgaattcccacaaaatgaatgggaataaaagtggagcttaaccaagagtatgttattgatagattccggtgacttttcaagagttttcaattcaggcataagtaattggctgggcatatggtggctcacacctgtaattccagaactttgggaggccgaggtgggaggattgcttgagcccgggagttcaagaccagctttgccaacatagtgagaccccgtctctacaataaaaatttttaaagagaaaacagataattttaattgccaatacagtgtaaactggaccctgattaataaatatgctaattggcctccctggatggagc

SEQ ID NO: 105847 - DNA, 481 bp, Homo sapiens
tcggcctcccaaagtgttgggattacaggtatgagccaccgtacctggccaatagggtttctttttgcacatacaaatacaaacgggttcttctgtcttgtatgcaattgtagtatctgacacatactgttcacttctttggaagtttggaataatggttcttgtttgaaattacatgtaccaggttgttacttgtagggtcaaataaagtagtcaataggaaaagactgaaaaaagatagaggaagccacacatattcagaaggaagaggaagacaatggcgttgccttttgtttgggaaccaaatgatcacttagccagtggcagagctgggactagaatcctgatgttttgactcccaacctagtgtattgttctttgtggtttacttcactaaacactgattgagtaaatgctacatgccaggtgctgtacctcagatttgaatatgacaccacaggccggatgtggtagttcaccc

SEQ ID NO: 105848 - DNA, 390 bp, Homo sapiens
tcagaatttgattggccaagactctggatttccagggaggttgtggagagataagatgaaatagtatgtgaaagaactttgaacaatgctttgcataaaggagatattcaatgaacattaaattgaaagaaaaagggaaggaacgaaagaaaaaaaagaaagggaagaaggagcttttcccttctctctacctctctgctgtgccccagtagggagagacattgagggttttaggagatctggtgggcatttttcctgggctgttcctaccaatagacttgctgctggtttcatgttagttaggtggcacaccaagaggggactcagaaagaacagaagatcagaacttgctggtgtcagacagaaaagacatgagcttgagccacattt

SEQ ID NO: 105849 - DNA, 262 bp, Homo sapiens
ctaaagtcttcctgcccattacaactttggtagggacatcagtatagcacacacagcaacatacactgtccacaaacaagacaagtgttttatcctacagaaacagacattacccaggataaggaaagtgtgacactctcatctgcctgttgataacacaatgccacaaccaggtttgccaaatatccaacaaatccattaaacaaagctagaaaaagaggaaacccacaaaagagcatccaagaactccagcacgccctaa

SEQ ID NO: 105850 - DNA, 773 bp, Homo sapiens
gaatgactgtaagcatgaatgagtaactttaagaactcagagtaatttgggatagacctctccctctgtggggtgatttcaacttctcgaaatatctggaagccttcttaggtaatttgtcatcctgcacccatctcctttccaatgtcccttatctcctggcattggactaatacactggagagttcattttcactttctccacaaacgggtggtattctttccctttgtccacaaacacaccaacacatagcatcaaactacctacttctaaacgttgagtgcaagttttatgattttacaatctttttaatactaacaaatattttttgaataccgatcatgtgtcagagactgtattaggtcttggaaatacagtgataaataagaaatgatttttgtctttaatggtttagaaagatgatttcaaatgtcttcactgcttatctaaggcagcaggttcaaccatgggtaggaggagccggaagcatagggaaacctcacaatattttcagtcatatttctttgttttggggaagcacaggactcttcattaccttccatctactttattatgtctttgttgttttttttttttttatcatcttgcttctgcatagaggccctttatatttccttttcatctctcaaattccagaccaaatattataccacttgactagttttccctgacatgttcagttttatagtggtctccttattatacacctgttatacctcttagcatattgccttatagttatactagcaat

SEQ ID NO: 105851 - DNA, 352 bp, Homo sapiens
  misc_feature (36)..(36): n is a, c, g, or t
gcggccctactactactactactactactaaattcncggccggtcgacaaaaaacaaatggaagttcacataaaaagcaaagcaaagggcccccaactcttcaactttatgcagaacagagaaattaaattaaagctacacagagatgccacttaacacttaacagattggtaaaaattctaagctttagcaatctggtctgcgaacaaagctgtgaagaaacagatattctcatatattgctcatgggagtctaaaatggcacagcccgtatggagaaaaatttagcaaaacctaacaaaaaaaatacatatttatcctttagtcgacgcaatctcacttctaggaataca

SEQ ID NO: 105852 - DNA, 475 bp, Homo sapiens
atgggcaccaggaactccaagagggattaactgtttataaactgtaactacaacttgcacactgaattttagccaactctcttacaagtagatgctgttggagcacccatttgtataagcggtagccctttctcactaactcatctccccatcttctctgcaagcatctgaagcatatttcactatatttcctgcgttttttcctctataacacctaggaggtcttaataaaaatatccaatccagtccagttatagaaaacaaagcaaaaacatcagataggttcttcatttactatataaagccacttttattctagatagttatagaatgtaaaggctaagagaaaacattagaagggtaagcttatgaaggttttcttcatgtaagaccaagattctatcattatgtccattttgttagaaaataagccttcaggccggacgccgtggctcacgcctgtaatcccagcact

SEQ ID NO: 105853 - DNA, 372 bp, Homo sapiens
ggatacaatatttgaccagctcaagaaccttcagtgcttgactgaaatttctaagactgatatttcttactgaaatgttcctttgggttttaaactgaggtttctattgtttgctttcaacagacatatgtttgacatacaaaatatggtaaagatccactacttctgcagtgttatatttccatattattcccttattggcctggatttcctcatcaatagcacaattcattcaaatgtggaaagaaaggcattgatacactgatcagagtaaggaaagtaatatcatatcatcaaaagtcacattaatctaaatgacaaatttattttctgttggtttccaaatctgggatgttttctagaagttgcaca

SEQ ID NO: 105854 - DNA, 414 bp, Homo sapiens
atccttccttttacagctgtctcatctccttgaaattatacatggccatggactgctttggccaatgaaatttaagtgaagtgatgtgaatcacttccaggcagaagcatttaagagctgatttatgattcaagctctgtttccttgccacagtggccgctggagacttgtgtttagatggcagtgtcataggatggtggatcttctgtcatcttgagtctttgaaggctacaatgcgtaggatcttttgtgacctgtgctggacaaataaagtagtataaataagaaacaaactttttttgatataccattgagatttgggggttctttgttgctacagcacaaactagactaacttgattgatactttataaaactctgcttttatgtaagccccttttatagctggatacc

SEQ ID NO: 105855 - DNA, 462 bp, Homo sapiens
ctcggctcactgcaacctctgcctcccaggttcaaatgattctcgtgtcttggcctcccaaatagctgggattacaggcgcccaccaccacgcccagctaatttttgtatttttagtagaaacagggtttcaccatattggccaggctggtctcgaactcctggcctcaagtgatctgcccacctcagcctccgaaagtgttgggattacaggcatgagccactgcaccaagccaagaattagaagatacttctaaaagatattttaaaagaaccaatggaaacttagagatgataaaacccaagcaggataaacaaagaaaaccacccaaggcacatcttaaattgcagaaaactagtgacaaatcttagaagcagtcagattaaacaaggcgtatgacatacaggcacaaagaagccaaggatttcttgtcccctcctccccctccacccaaaaaaaaaa

SEQ ID NO: 105856 - DNA, 328 bp, Homo sapiens
ttacacagcgaagttccattaatgccccccaaaggaattccaacttgatacaaatgtaatgaggaaagcccagctaacatgactatgtgctttggaaagttaaatctagagacaataggaagaagatatggagcaggtaaccaatcaggaggcctttcactgagggaacagtttctgctatgaaagcagtaggccggttttataatttgtgggtcattttgaatattgtcacggttatttattatgtaactttaatatgcattttaagagtttctgcaataattcacatgattttttatgttaaaataatgataaaagttttttcaaa

SEQ ID NO: 105857 - DNA, 478 bp, Homo sapiens
aacttaattagacatagggtatatataaactcaattttatctgcattttttaaaaaattgaaataatctgattgcatgtatgaaggactcctgcctcattacccaattacataaatacaattatctataggaaggtgaaattgttgatctattatttcaaagacttgtagactagcaaagattcattctgattagaaataaggtctatagctaaagatatttttattttaaaaaattacagcccttgtaacaaaaatcatttgtaacattggatatgaagacattattagtatttaaaattattgtagtcatttgatcataaatgaagtagcttgcaaaatagacttggtctttgaccctttaaggtgtaactgactgactgttgtgtttttcaagactgattttaggcagttttatgtatcgtgtaccaatgatatgtaaaataaagcaccttttctactataaaaaaaaaaaggtg

SEQ ID NO: 105858 - DNA, 325 bp, Homo sapiens
atggccactccatggactttgtgaaccacagtatcctatgtgacaattacatcccctttgtgaggaccagaaaaacaggctgaagaaatgcaatgctaggtggtgaggcagagaaaacagatgtggctcactgaggcaaccagctgagcctggttctatcacagctgctgcaacagcacagttgtggagtgatcctggttctcacatgcacgtctcagatttcctagattttctagttctctgtctgcaaaatgggaggggctgcccaagtgcttacccgatcgagaatacagggctttacaattcactctgcaagtcttcacca

SEQ ID NO: 105859 - DNA, 857 bp, Homo sapiens
acttgcacagctgttctgagatttcctgcagttgtccagaagaaaagaaaaatgttttatttaaagatatgtattatgtttagtacaacagagtggaaaacccatttttcataaaagacaagctattcattccaaacagataaaatgttaagcttcttgcactttacaaacaatggtccctctgctgccaatgatcttcctctgactcttcacctaaatcgtacacatccttcaggtcttacttgggacaatcctccatgcacaagccttccttgattctccccaaatatgggttaagggttaacatatttccattacaccctaaagacctctatcatcactcttaactctataattgagagttaacttgtttctcccatcaggacataaactctgggtatgaaggagaaaacactaaatatttacattttagctcctagcagagacagagaaatacataagtctgttttgaatgaccaattgctttgaataacagcaagaagggggagaagttgaaaataggatgtcctaccttgcaaacaagctacaaaaagaatcctccaaaaaagtggaaagtgataccagttaaaaaagaaaggctgggcacagtggctcacacctaaaatcctagcactttgggaggctgagccaggaggatcacttgaggccaggattttgagaccaccctgagcaacacagttaagactctgtctctattaaaaaaaaaaaaaaaaaaaaaaaggaaagaggtttaattgactcacagttcaacatggctggcaggcctcaggaaagttaaaataatgacagaaggggaagcacacgtcgtccttcacatagtggcagacaccgtcgaa

SEQ ID NO: 105860 - DNA, 228 bp, Homo sapiens
ctcaggagggctaccttttccttcctggagagaagatggaagagatcgcagtgtgtttgcatgtttcttcagtaaaacagacatcctggaggtgaacttttgagtctgagcaacataagcttgttctgacctgacagatgcttgcctttactctgtggaaagaagtgtgttagccagtgtcggattccagccggtaattccatacccctctcccacctcatgcaccag

SEQ ID NO: 105861 - DNA, 262 bp, Homo sapiens
taaaaacatcccctgtcttcagcaggggtccagggacctagacaggtgggggaccacccgttgttacggagtgactgggagggccacccgaggagagccaagcaggggaccacccctcccggcatgggcagacctagcagggcagccccgggacttggggcgtgagatccgacttcctgaggctccactcctggcggggggcaggccaggccaccgtggctctccaaggaaggcgcactgcctagctgcgtggagcgtggtt

SEQ ID NO: 105862 - DNA, 228 bp, Homo sapiens
taattgaaagcattttttaaaatgaagacggtcctattttggaaatgcagaaaggcgagatgaaagccaaactctggtgagtatagcagaactaattaaacttcagagatctaaaacaatcaggattaatgttaccaataaaacaaaacaaggtgacggggcaggaagaccgatgctgagtagaaaaagtattctgtacatacattctaaatgttaagcagtcggcct

SEQ ID NO: 105863 - DNA, 361 bp, Homo sapiens
cagtgctgatcttgctaattcaaacttaaatcttttccttgttataatattccagacttcctttaattccagcagtttattttgtttgaaagattatacctatgtcaaatttaggactgacacacgaggtagtcatgatgtatgtgtgtgtatatactttttttttaagagacatggtctcacgctgtcacccaggctggagtgcagtggtatgatcacagctcactgaagcctcaaactcctgggattaaatgatcctccccacccaggctcccaaatagctgagactacagacatgttccaccgtgcccagctaattttattttttagagagacagggtctcactatgttgcccaggct

SEQ ID NO: 105864 - DNA, 93 bp, Homo sapiens
gatgctgcgcagtgcacaggagggaagttaattcattatagacaatggatgcctcagggcctaagggctcagttcggtggagaaacccatttg

SEQ ID NO: 105865 - DNA, 131 bp, Homo sapiens
aaaaaaaaagaagcaattcctcatctgttcaggttttattatgagattgcaacaattctgtcacatcttcaaactccatttctaattgtagttcactttccaccacatctgtggtgactttattcaatgaa

SEQ ID NO: 105866 - DNA, 388 bp, Homo sapiens
tcttggttgagtagatttataccttggaagctctggttaagatagaataaattatgatataacattccttctccattcggtggtggtggtggtagaggtagctactccatgtacatacatttctacagtgggtttcaggctgagctctgggaaaggatgtcatattttaccaccttatatatttgatctgtgtatctcatacatagattttggctcttaaagagaatctgaattagaggcacttcaggaagcattcacatatctagaatagatgacttggctatcaaccccttgccggctgtagctccccatttgttgtagtctgtatgtgctatacccaacctagagcagggcgccatgcctggctaattttttttttttacttttt

SEQ ID NO: 105867 - DNA, 352 bp, Homo sapiens
tcttggttgagtagatttataccttggaagctctggttaagatagaataaattatgatataacattccttctccattcggtggtggtggtggtagaggtagctactccatgtacatacatttctacagtgggtttcaggctgagctctgggaaaggatgtcatattttaccaccttatatatttgatctgtgtatctcatacatagattttggctcttaaagagaatctgaattagaggcacttcaggaggcttaggcaggagaatcacttgaacccgggaggcagaggttccagtcacctgagacatccaactcactccagcttgggtccaaaattaagcttttcttaaaa

SEQ ID NO: 105868 - DNA, 211 bp, Homo sapiens
cccaacactttgggaggccgaggcaggaggatcaagtgagcccaggagttcaaggccagcctgggcaacatggtgagatcctgtctccatttaaaacaaacaaacaaacaaaaacttgaataaaagaaatcactcataactcccactgtcagagatactgctgtgtgtgtacatatgttcattcatgtgttttaaagcagtagtcacagga

SEQ ID NO: 105869 - DNA, 685 bp, Homo sapiens
tcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaactttcagaaggaaaggagaatgttttgtggaccactttggttttcttttttgcatgtggcagttttaagttattagtttttaggatcagtactttttaatggaaaaaacttgaccaaaaatttgtcacagaattttgagacccattaaaaaagtttaatgagaaaaaaagaaaaaagaatatcagcagacacagatctgtgg

SEQ ID NO: 105870 - DNA, 277 bp, Homo sapiens
gttggggatggcataagctatgattgcctcactgcactccagcctggacaacatagcaagcccccgtctcttaaaaaagaagaagaaaggaaaagtgaagcaaagtgagaatgacaggagtatgtggaccaacgtaaaaataaatgtaggagaaagactggccaggcgcggtcgctcacgcttgtaatcccagccctttgggaggccgaggcaggcagatcacaaggtcaagaaatagagaccctcctggctaacacggtgaaacccggtctctact

SEQ ID NO: 105871 - DNA, 476 bp, Homo sapiens
acaggcgagaagcagccgcgtccacatggcttcaggtgttcacatggcagtaaacgggcccctgctctcctgggcgccccagcgcggcgccctcccgcccacatcccggcccagccccgctggcctcgcctccagcccgtagccaagaggcgagcgcggccggtgcccccggggctgccaggggccccgaagcaggcggcgctgactcccggacgccgcccgctcacacccgccgcctttgcacccaaggcctcgcgcgaccagcagatggggccactgaggtgcaaagagtttaacttatcccaagtcacacagtttggaagaggctgagctggtatttgaacccaggttttcagaggctgcactcttaaccaccaagcttcccagcactcagcaaacactggaaagacagagatggacctagacagtcagtaggaccaaaagtctgcaggccgatagggaaagaatgtaagagg

SEQ ID NO: 105872 - DNA, 321 bp, Homo sapiens
ttgtccacctgttctacctcaagatgatgttgatatttcagactcaacattttgaaggctgaagtcatttactcttctccacaaggtatggcttccaatgtcttactttcttactactattctctaccctcctaggtctaaactttcagtcagtgttggattcattttgctcacttacctccccgtccagtcaggccccatttgcagcccttctgcgagccttctttcactgcttgccagtcctttcccatcaccactgcccccagtcactgccattttctttttaactttcttgccaggaatgttctaacagtacccaag

SEQ ID NO: 105873 - DNA, 375 bp, Homo sapiens
gttggacacaaaatatacacgaagaacatggaatatcttgttatatgagaggcaaggaaatatcaaatactattggggtcatctcaaaatgactcacaagggccagcttgaaaaccttcctacttaccacttcgcacctgttagagcagctattatcaacaagatgaaagataataatgttggtgaggatatagaagaaagggaacccttaaattgctggtgaaagtataaaatagcactgctgctatggaaaacactatgaagtttccccccaaaatttaaaatagaactatcatatgacccagtaatcccattaatgggtatatatccaaaggaattgaagtgagtgtgtcagagatatttgaaaagagaata

SEQ ID NO: 105874 - DNA, 235 bp, Homo sapiens
tatttacagtcaattgatttttgacaaagggtccaagaacacacaatggagagaggacagtctcttcaaatagtgttgggaaaactggatgtccacctgcagaagaaagaaactgtactcttatctcacactccatataaaaatcaactcaaaagagatataaaggcttaaacataagacctgaaactgtaaagctactagaagaaaatataagggaaaatctccacaacaatgg

SEQ ID NO: 105875 - DNA, 807 bp, Homo sapiens
ctgagatcccgccactgcactccagcctgggcgacagggcaagactctgtctcaaaaaaaaaaaaaaaaaaaagatcagaggctccactgatgttacttgggaagaacatattagatgtaggaactgatgtataatctacagtgccaacttaatgggcattggtaatgattttatgcttctgctggtcatgtattttaaaggtggaaacccctttttagtacgattaattacattttcagttaattattttgtttccagtgataagaatcctcttggtttcttagtattggccaaagtgcccggtttgtagtagttgcataatatgtttgtcaaactgaattgaagttaaaatctcaccagtgagctgtctcaaaagtcatattctcagattgattactgaagaattcttggataagtcccctctgctctgcagaatttgtttccttcatcagcgatgctagtgtgtacattcggactatatagaaacttcgtgggggtacttcttatttggacacctttgtcagcagttacaaaatgcaaatggactttgccttcctggattcagaaagctggtggagcggacagaactaatttcatggtttattcttcacacatttgacttttgacttcagatcgtaggttttcatttttcagcttcagctattttgttatggggaaataagatgtttaggccaggcacggtggctcactcctgtaatcccaacactttgggaggctgaggcagatggattgcctgagtttaggagttcaagaccagctggtcgacatggggaaaccctgtctct

SEQ ID NO: 105876 - DNA, 441 bp, Homo sapiens
ggcagaatgatgggcctgtagcgcaggccgggatggctccagcatcccacggtatcctggcacttccaactgaggggtagtcacagcaccctgcatcgtccaggaagtctttaaggcagagaatcttcctctgaagcactctgggctctctcctcaattcccgctcaggccatcagcaagtcctgccaaatctatatcctcacccctccagcctttgtttctccctctgtcttcatctttctgctgtagtccaggccactgctactcttgcttgagctgtggcagcacacttgccacagtctcctctgcccgctccagccgctttccagccacagaggcacctttccaaaacagatatgaatgtgcttctccctcacttaaaacccttcatgttccctccaggttgtgtgtcacttaaggtacactgagctccaggcctgt

SEQ ID NO: 105877 - DNA, 743 bp, Homo sapiens
gcctgcagtggcctaaagacactagcctggttagcgatgacctgcatttctctcatagagcacctcccttttcatcgtatccactagctctctaagtcctccttaatgaggacacttgatcctcattaagtctgccccttaagatggcttcacacctactgaaaaactccaggggtttgacatctcactttgattgaaatcttgtcttcctataacatttgattccctgggctcttcagccctatcacctctgcttgtctttatccactctcttcttcattcacttttggctacacaggccttccttccatctcttgactcttgaccacctcagagcctttgtatccgttccctttgcctggagagtttttcccttgcatcttttacttgtcactcagatctccactagttgtcgcctcctcctggagctcttcccagactatctaaagtagggcttttcttcccctcccctctatcttgcccccttactgaaatctgcttccctgtttcttcttcttttttttttttttttgagatggagtctcactctgtcgcccaggctggagtgcaatggcgctgtctcagctcattgcaacctccacctcccgggttcaagcgactttcccgcctcaccctcccaagtagctgggactacaggtgcacgccaccattcttggctaaattttgtatttttagtagagatggggtttcaccatgttgactaggctggtcttgaactcctg

SEQ ID NO: 105878 - DNA, 315 bp, Homo sapiens
taaacctttccattttatcttttaaaaccctccccagtaatatatgatctgtattagttacttattgctgcataagagaccacctcaaaacttagtggtttaacaaaagaaccattttgtttgctcagcctggcctgggctgagctgggtgatttttcttctaatctcacttaggactattcatgaggcttcagtcgtctagtggcttgattggaactggatggtctcaagtgacctcatggctagtattggtgccagctgttggctaggcctccttgtccgcaagatctttcattctcaagggagctaccccag

SEQ ID NO: 105879 - DNA, 435 bp, Homo sapiens
tgttttctaaaaaacattgacattcttattcagtaaagataaatgcaattattgctttttccaatagcaatacagttgtaataactggtagctgtttctgccttgcccccttacagtctattcttgatgcgtcaaccagagtgatccattcaaagtgcaagtcagaacatgtacactcctctgctcaagaccttccaagatttccccattcagagttaacgttgaagtccttacaatagcctgagtgttgggcatgttctccacctctgtgcttctttacatctgaccccagccattgctctcccctggctaattcttcctcagctgcaccagtccccttgctgtttctagaacaagctggacatgttcttgccttaacgcctttgtagtcgctcctccctcaatgtgggatgctattcctctagagcatctgtg

SEQ ID NO: 105880 - DNA, 627 bp, Homo sapiens
caccaagtaatcggtagagtgttttgaagattgttgatcaggcaacagtcttcaaaacacaggatgtgcggagggaacacatctcaggacatccatcgtagtcaagggaatatttcctaaggagaagggatatttaagtggagacccacagcatatggagagttagccagataaagagagagcagacaaaaatgtttcaaaccaaggaggcctccttggaggtagtgaagaatttccatgtgatcatatgactgtagactgggaagaaggagaaagatgagaactagaccagagataagtagcaagtagcttcctgtggtatgtcctaggggtgttttgttggggttgacagataaacactaccagacacaatgggaggaagtagatttttaaatgggaagctggtgaaaggatcattcagatggagtgataatattactggctcccagacacctatacagtctgctggtttcctggaagtaataccacccacagaatgaggatggaatctgttgtgcagagctctctttgccattcttatgggaccttctccacctgcctgccccttcaacaggtgtaagtaagagaggcaagaccgccctaatgtgccagctatttctcatgaga

SEQ ID NO: 105881 - DNA, 188 bp, Homo sapiens
tttaagtgaatgttagctttatgttcttataggttaggagatgttagtcaaagaggatgaataacatgagaattttttaagagaaaatgaaagtgatttctaaaattctcttttgcagcatctgtactcttgagctgtttttaaggcagtaaagcaatctagattaaatcagttgtcctttttttagg

SEQ ID NO: 105882 - DNA, 638 bp, Homo sapiens
gtttatgtcattaaatgcttatatttgaaaaaggaaaatcagtgacttaagtttccaccttcagaagctagcaaataatagcaaattaaatccaaagtaaatgaaaggaaggaaataataaggatcaggtgcaaatcaaggaaatttgaaaaggagaaacaatagtgaaaacatgaataaactcaaaagctgtttctttgaaaaacatcaataaaattgacaaaattttagccagactgatgaagaaaaaagaagatacaaattaccaatatcaagtacaaaagaggaaacatctctgcatatgtcacggatcttgaaaggataagggaatattgtgaacaactttatgccatcaagtttgataacattaaatggagaaattccttgtagagaaggagtggaacagactcaagaagaaatagaaaaattgtagcccactatgaggacaagaaattgaattagtgtttgaaattcttcctaccaagaagcgctcaggcccagatgatctcactgatgagttttatcaaacatgtagcgaagaaatactgcctgttctacacagtgttgttcagttagcaaagaagtaacacttgtcagctcattttatgaggctagtattgcccagataccaaagtcaa

SEQ ID NO: 105883 - DNA, 675 bp, Homo sapiens
gtggattcggatactttttggctttaggggattttgtaaaaacataattatttgttacatatacagaataccaccctggagccaaaaaagtatccgaatccacaacaaaaaacgatccagtgaaaaatattcacattgaaagctcacacaatatagacctaaacaaaattgcaatgaattctaatttacaagtggttgtgaagcgtttggaagatacaataagtatagccaaaaaatcctggaataatcagccattatcagaaggatataaagcatccaagaaattgatagaaattgatggtaaagaccaacatgctgacagaaatatgactcttactctaaatagaatgacatgcaaagaacagagcttatcaaaatctgtggtagcatccggcaatattatcaatagtcactgcatgcctacagtggatttgaataacaaaagacttgaaaatctgaaaaagtcatctattttagatatgggtcgcttgatttccagtgttgaaaatgtaccagcaaaatatgaaggtactgaaagttcatctgtttccaactattctagtcctatcaaactcatgtttttatctgaggttaaaagtagtgaaggggtcaaatatactttaacttcagttggcacttcccattcaaatgttgttctcccttctgaaaaaccta

SEQ ID NO: 105884 - DNA, 366 bp, Homo sapiens
gagaaccagcaatctaggagaggctgagttccagtgaggtggtggaggaccaaagcccaccaaaccagacgtggcttctgccccagagggtgtgcacacgagtagcagatccaaccagcacaggaagccgttctatctggctacccaggtggcaggacaagtccatccctggagaggcaagaaagcagacagctacggcttaggtctagagaaagatccccgcagtgggcctttctctctggcttccccaggaaggcagcagacaatgccagggttgacttctgagtcctctgtgctgatgggcctgatccccatggaccgtgaatccttcttctcctcttcctgctctgcttcttactaagtttg

SEQ ID NO: 105885 - DNA, 440 bp, Homo sapiens
agattgcgccactgctctccagcctgagcaacagagtgagactctgtctcaacaaaaaaaaattattacggatctcaagacagcagcagcagcaaagcgttaaaccaggtgtggggtccctcggagaacaggcccttgtgcttctctgggtcaaacgtccatgaagctggccctgagtggcctttcctgtttctcatgaccacagctttggatggcacccaaaacggctcccaaagggcgctcaagacgtgcctggaactgtcatgacaaccccaccaggctggaactggtatgatccccattttaccatgagaaagctgaggcttggggagataagtctcttgcccggggccacacatcaagaagtactgaactgggaaatgaaccccggctgcctggggcagagtttgtgctcctgggtcaggctcttaccataaacc

SEQ ID NO: 105886 - DNA, 668 bp, Homo sapiens
cattttggtcacaaccacttaactagtctctaagttccaaactttccctcatctttctgtcttctgagccctccagattcttccaacctctgcctgttacccagttccaaagctgtttctacattttccaatatgtatagcagtgccccactgtcagtactaatctgttttaatctgtttgcattactgtaaaggaatatctgagattgggtaattcttgcaaaagagagatttaattggcttacagtttctgcaggctgtacacaaagcatggcaccagcagctgcttctgatgagggcctcaggaagcttacaatcatggtagaaggcaaaatgggagcgagcatatcacatggtgagagagggagcaagagagaggaggaggtcccagactctaaacaaccaaatttcacatgaactaagatctcactcatcaccaaggtgatggtgccaagccattcatgaaggatttgccccatgattctatacctcccacgaggccctacctccagcattgggggttacatttcaacatgagatttggaagtgacagccatccaaaccatatcagcaacataacaagacccccaactcttaaaaaaaaaagttgaatatatatccaaaaatatcttgaattccatatggaaagcctcccccctcaaatttgt

SEQ ID NO: 105887 - DNA, 379 bp, Homo sapiens
cccttctctgtctgtatatatgaatgtgtatatacttaacatacatatgtgtacacacatgtgtcaagtggggtcattcttaccttgggggtggggcagaggtaccctcagatcttctgggagcatgtatgtttgaaagagtatatttaatatcattttatgtttgaaaaatgaaaactaaaaaccacttttataatacaaactacagaaaacaaaattcacatatcctgttgatggaataaatgattgaaaaccattattttattttaaaggatccaagtgtatcctgtaatatcagagtgggaagggtactttgagattagattattcagtgtggttcttcaagtttttatagttttttactatttatagtttttta

SEQ ID NO: 105888 - DNA, 317 bp, Homo sapiens
ctccatcctattcgaaaaaagaaaaggggtctctgtagagaaactattaaaaaagtttaaacagcctttacagaaacgtggtttggtggcaaagaaagggaaaccaccaccccttccaaagctcaccaggagaaaagtgagaaataaaatatcaaaatgaaattgactccacacaaagatatctgatcaccagacaaaacaagtaccaaagtgcagaaaaatattacaataaataacatcagattctttattcaagccaggcaaaacttatgtagtttttcctaaccaggttaattattttcctcatcttcttttcc

SEQ ID NO: 105889 - DNA, 139 bp, Homo sapiens
tttcacagttaagggctttttatcttctttaaggcaaatgatctacacaaaatttatttttttcatgagtgcaagaaaccagtcaaagaattctaagcagagtacgttctttttttttctcgagacggagtttcggtct

SEQ ID NO: 105890 - DNA, 407 bp, Homo sapiens
gggagaataagaactctttagcctgaagggaaaaaagagtcaagagacagtctctggtttccaaattcatgaagacctaggttcaactgggattagcgccttagagcagtagtaacatcaagttacactaaagtatgactcacatgtataatcaagaattttctaacaaaccaatccaactctgttccagaaaatattctatcctactgtttgagatttttaaaactgatttctatactagatgaacaattaaatggaatacatatatttctcagaaccaaagaagtttaagctataaaaactacttttttaactcccaatgtgatgttattggaaatggggcctttgggagataattaggtcatgaaggtggagccttcatgaatgggattagtggcctaataaaa

SEQ ID NO: 105891 - DNA, 659 bp, Homo sapiens
gtttacacatatacacacaatatataatagtgcctagcacagtgcaagttctgcataaatgtgtgctgtcatttttcttttttaattttatttttaatgttttgtagagacgtggtcttgctttgttgcctaggctggtcttgaatttctggcttcaaaggattctactgtcagggcctctcaaagtgctgggattataggtgtgagccactacacccggcctgtgctgtcatttttcttacctcacctccggcctggtctgagttctggcttcctgatgggcagtgttctcagtgattgataataaggggccagcagaatgacgttggggtgagaggtgtgtgcctgtgaagcgtgaaccatcatgggctagcttccctgttgatcagctctctggatccctgggtttcaggtacccctgggggattgtgggggcaagtcacattatgttctccctgccccagtgattggaggagcaagtcacatatgccgcttccaaaccagccctggtgcttgtgaggatgagaaaacagtggacgcacagatgcttctggcctgtgcctggcctgaagttgccccatcactgtccattttcttctctcctagtgacttctcattttctaggaatctggaacaggtgctttctccagccactttgg

SEQ ID NO: 105892 - DNA, 548 bp, Homo sapiens
ttcagtgtctactcgttcacttcatcttaaggccgtgtgtcccccggactctgtgtgttgccatccttttccacctgttccttctctaattcatatcacgactgtacaatttctggttttctttcaatgtgtgcacagaaggaagctcaacaactttgttgagccaggaagaaattattatcaacatttataatcaggccaaatttcagctgagtagtgactttaaaagaattagttttaatctcaaaataaaaaaaaaaaaagagggcaggcgaggtggctcacacctgtaatccagcactttgggaggctgaggcgggcggatcacgaagtttaggagatcgagaccatgctggctaacatggtgaaaccccgtctctactaaaaacacaaaaaattcgccgagtgtggtaataagcacctgtaatcccaggtactggggaggctgaggcaggatgattgcttgaacccaggaggcggagattgcagtgagccgagatcgcaccactgcactccagcctaggcgacagagcgagactccgtctcaa

SEQ ID NO: 105893 - DNA, 545 bp, Homo sapiens
ggacacacgtggcatatggctaccatattggacagtgtggctctgaagagtgattattttatgacccacctctgttctccctgggcctctcttggttctctcactgtccaagtgtgaatgcctccagagtttggtcctcggtcctccatcatctgcccccacattccattctcctctttgaagatctaattcacaaccacaacaggagctcaccgtggaaaggacattaccccagtgcctcatacccattttcacctggatgctcatggtatttcaaattcggcttatcccaaagcaaatccatctgtgtcaagctggcttctccactttcatccatgcatctttcattttcctgacttctaatgctcccgctaatgttataaagcagttaacaaggcaatcaggctacataagcagaaatctgtgaatactaagacccgcgagctgagggtattatggaaattgaatggcacttgtaagaaagccgaacatgtataatgacgtacataattcttataggcagcaaggtgactaggcatgtctag

SEQ ID NO: 105894 - DNA, 1517 bp, Homo sapiens
atttgatccaagttggagtcagacacagtatttgagctgcacggcttctgggttctcccaccttatttgatcatattcgaaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtgttaaaaatctttgttgtggtttgagcatctttgctgcttttggattgagatggcgaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttccaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatgaaaatctatatcagagttatattttaatttttattctaaatgaaaaaaaccctttttacttcaaaaaaattgtaagccacattgttaataaagtaaaaataaa

SEQ ID NO: 105895 - DNA, 1463 bp, Homo sapiens
atttgatccaagttggagtcagacacagtatttgagctgcacggcttctgggttctcccaccttatttgatcatattcgaaagattatttcctgtgtttgctttgatttgttcctcagtacattaaaatgatccacaccttgaacactgccctctctagaaggttgattttgatcagccttttgaagatgggtgtcgtttccctaacttatctcacagaattttgagtgttgtatttggcaagttctgagatttgccttctgtcttatgccaaacacccctttctaagagctgtccccgcttagttttagaagtactaggggttttcatacttattttatagaacacccatttatatttatttctgtatatagaactaaaaaaaacagtagtggaatcaaggcttcacttcctctctcttctgtctttagaaagctgtgatcgtgcgtgcaattatttgaaaggcaacatagtcaattaagaaacctgtagttgttaaggaagaaattgttggcaagatatccatactgcccatatctcgttggtgcaataattaaatagcaaaggaaatctgtattggcaactattataattcaataattcttttgtttactgcccttttctgttcaagaattttctggaaattactccctttcacatggttgaactcttaagttgaccagttctcatagctctatcactagaatggtttgcagataccccaaacatactatgataaaatcaaattgtgctacttttgacccatgtaatttacctaaaagttgtaattgctgacagagtactgccttgaattttggtttaaaacctctctagtttccaatgacaagtaacaactcaaataattccatattgtttgaggaagaggccataatccttctgaattgttggcactaagtaatgggatttggcccagtaagtatgacggtcgtgtcgcctaaccaacgcagagcagtgctttttgtgtggctgaagcgatgtgctgacgaaaaaaggaaaattctaggacaatcgttggctaaaaatcaccttaggatgaaaaatttgaggcaaatttttttaaatgacagaaaaagataatcatctcacttgcttgaaacaggagccagcatgatctctggaagcatcaactatccctcgtcgtgattgttgaaagctctttcactgttttgcattctagtttgaatagtttgtattgaaattggattcctatcttgtgtatgtttttggtgcgtaaaagggaaaaattggtgtcattacttttgaaatttgcaggacgaagggcatgcttttggtttgctgtaagattgtattctgtatatatgttttcatgtaaataaatgaaaatctatatcagagttatattttaatttttattctaaatgaaaaaaaccctttttacttcaaaaaaattgtaagccacattgttaataaagtaaaaataaa

SEQ ID NO: 105896 - DNA, 570 bp, Homo sapiens
cggtgcgcgcgcctagctggcgggaccgttagctctaggcagacgccgacgggccccgcggggatggaacagccgccgcctctggcgcccgagccggcctcggcgcggagccgcaggcggcgggagccggagtctccgccggcgccgattcctctctttggtgctaggactgttgtccagagaagccctgacgagccagcactgagcaaagctgagtttgttgagaaagttcgtcagagtaaccaggcctgtcatgatggagacttccacacagctatcgtgctgtacaatgaagccctggcagttgaccctcagaactgcattttgtatagcaacagatctgcagcctacatgaaaacccagcagtaccacaaggcgctggacgatgccatcaaagcccggctcctcaaccccaagtggccaaaggcatacttccgacagggtgttgccctccagtaccttggacgtcatgccgatgccctggcagcctttgcatctggactggctcaagaccccaagagtctccagcttctggtggggatggtggaagccgccatgaaatctcccatg

SEQ ID NO: 105897 - DNA, 228 bp, Homo sapiens
ctcccaaagtgctgggattacaggcgtgagccaccacgcctagcctctttttgttttctatttttgcctcactgtgggctatgaatgggctatgtgtttatattctgttctcttgccacatgagatcttatatacctgacgccagcaaagaagcctggaaaattatggtcctgatttaactgtgcctcagttatccctggtgtgacttgggcattaatttgtctcacc

SEQ ID NO: 105898 - DNA, 734 bp, Homo sapiens
gattttaaatacctgcctccctgctaacttactgtgtaaccctgggcaagtcacttaacctctctgagctctggtttcctcattgagaaaatagttgtttaatgattaaaggtacctcatatgagctcaaataatattaatccccatccctagtcccttccctttaaggtagtatgtcagattagtagcataagaagatccaaacctgtgtgtcctcttagtccagcgttcttcctcccttatgcagtttccgtcatcaacattgcctttctgttgccctcataacttatcatacggagccaggctatataattagctacttctctatccgcctcttggtacttaccaggcaagcttacctgtcatttccagctatcagctatttgtcaagcatcagtcacccccaacagcccccctgccatgcatttctactgttaatatctgtatctgtctccagagctctctaatctgtcccaccccgtagctgttttacatctagccatatacttctgtctgctctcattaaactgcctccccaaaactggctaatttatatttccgattttctattagttatatgttcttcctaacaataagaactatttacccatttgttcattatctttgtcatctattttaccttctgtgtttccaccattcatctcaaacttcatctccatagagctatttcgcaactgacaaacagtatattcatatgtctggtaatggttatc

SEQ ID NO: 105899 - DNA, 253 bp, Homo sapiens
acctgccccccctccgaatgatgtgtccatttctcagaacctgtgaatttcatcctacttggaaaaggaatctttgcagatgcaatttaaaggacctcaagatgagattatcctggattatccaggtgggctctaaatcaaatgacaggtatctttatgaaggagacacagaagagacacacagagaagaggtgaaagcagtggataggcaaaataaaggcaaaggttgaagtgatgcagcctcaaaccatgg

SEQ ID NO: 105900 - DNA, 283 bp, Homo sapiens
ctgaagcccagagaggttaaataacttgcccaaagcctcacagcaaagttgaggaagtaaaactgggcctggaatccactcgtctgatcccctggcacatgacgcaaggcttgaccttagagggactcgtttccagacagagctctggcaaaggagtgtcttgggcagcttaggagtagaagaggaaaggtgaatggaaaccaggccttgggttatgagctgcgcaggattttccagcatctcagatgcaggcgtttagagaaagagatataatggagcaggc

SEQ ID NO: 105901 - DNA, 637 bp, Homo sapiens
tctaaggtgtgcttaaatgatccatttaaggaattttgccagctagtccgttttgttttgttccttctactgtggatggatgaaaaagcagttataaaaccatcgctaaagaaccaaaggcaaagacaggattcgtacatcctaaactccctgttctggattctcggtggatgtaagaatatcaaaagttacattgcattttccacagtggagaaatataatttaacaaaagcaccgtgagtggtacataaactctttagtagctggttaaaaggttaaaggaaaggagagtaaataactcatccttaagaagggagaagactccctgatcctggttttagaaattgatccctagttcaagcacaaagcaatgacggggaaaaaaactgaccacaaatattgttttctccccattatgtctcactccagcctgcataattagttggagaaagtttcacgtctgatagccccactctcagtccatgtctgcaaaattacgactgtgttgtggtttcttagctccgaagactccatgggcatttagcaggaaggccacatctctcattcagcaaggtggcaggttttgcgggggttctggggagtttgtgattgctgcttcgtgtgcacagagtgagaa

SEQ ID NO: 105902 - DNA, 416 bp, Homo sapiens
gattcatcatttcaaagaattcgttgctttgttgatttttcacttttacatgtttgttctcaagtttttaatgttgcaagttatgctccctgggaagcagactataggtaaaacatagcacagtaggttgattgggtagtgttcttggaattaacaccaggaaggaaaggaaaggaagcagaattgaaagacaaagaagtttgactttgatagagaccaccctggccaacatggcgaaaccctgtctctactaaaaatacaaaaattatctgggtgtggtggtgcacacctgtagtcccaactactcaggaggctcaggcacgagaatcacttgaaccccggaggcgaaggtcgcagtgagccgagatcatgccactgcactacagcctgggctacaagatgagactccgtctcaa

SEQ ID NO: 105903 - DNA, 883 bp, Homo sapiens
ttgaggagacctaaatgtctaacaaacactcatacacccaaacacccgctcttttcctccatactttcaatcatgcgtgccttcccgcagcagacgtttgggtccttcctctgagcctggcactatgaagaccccaagattttcaggttctgaacacaagcccagtttctgcttctgatgatcattttcaatagagcataaaaaacagagccatgttccacgtttttacggcctctgcacttggcaaaatattcttcccgaatggcctcacgtgtgctccctatcatcacgccttttcagctaggcaacgctcagagtcacacctgagtggaggccgacgcccctttggaggcgactccagccataaaaagtcctgcttggagctggttttagccacagagggccaataaatggccccttctgaatgaggtgcccctgcacctctgcagagcctgctgccagcctccaggatctaactgggctctgattcaccgctcccaaccccacatccagagattggccgggcatggtgactcacgcctgtaatcccagcactttgggaggccaaggcaggaggatcacctgaggtcaggagttcaagaccagcctgggcaacatagtgaaactccgtctctactacaaatacaaaaaaattagccgggcctggtggcacatgcctgtagtcccagctactcaggagctgggaggctcaggcagaagaactacttggaccagggagacggagattgcagtgagccaagaaaaggctgggcacggtggctcatgtctgtaatgccagtactttaggagtccgagtctggtggatcacctgaggtcaggagttcgagaccagcctaaccaacgtggtgaaaccccatctcta

SEQ ID NO: 105904 - DNA, 430 bp, Homo sapiens
gggagacgggaaggagaagaaaaacaaaagtgagaaaaagagctgaaaatgggacaacaagaaagattcctttttaaggaaaatgaataaactacctgtcaaaataagtataacatccttttcattctggaattttaggaatggttgccttcccttccaaaaattccccatccagttatcataaagcgaattatctgacacctatacacattacatactaaagtatttattgaatgagcaaggaccaccagtcaacaagctctacctatatacaacatttccaatcagtctatctattctctcacattaaaatacgtctagacaggccaggtgtggtggctcatgcctgtctgtaatcccagcactttgggaggccgaggccagtggatcacttgaggtaaggagttcgagaccagcctgaccaacatgg

SEQ ID NO: 105905 - DNA, 643 bp, Homo sapiens
gggcggttgctgcagctttggccgaggttcgggctcgaacttggaaaatgctcctggcgcctcagggaaggtccttctcaaagaaaaggatggggctgaatcgctggaaacggttcacaaggaagccgagtcccaagcctacttttggtcctgacagtgtggaacactggataaagagagtggagaaagcctcagagtttgcagtgtcaaatgcattttttactagaaattcagatttacctagaagtccctggggccaaatcacagatttgaaaacatctgagcaaatagaggatcatgatgaaatctatgcagaagctcaagagctggtcaatgactggttagacaccaaacttaagcaagaattagcaagtgaggaagaaggtgatgctaaaaacactgtgtcaagtgtcactattatgccgggagccaatggccatttgaaatatgacaagtttgatgatttatgtggctatttggaggaagaagaggaaagtaccaccgttcaaaaatttatagaccatctgctccataaaaatgtggtagattctgcaatgatggaagatcttggaaggaaggaaaaccaagacaagaagcagcagaaggatcctcgtcttaccatggagatgagacataagcaggt

SEQ ID NO: 105906 - DNA, 413 bp, Homo sapiens
actgaagctgtttgtcaatttaaacacttttattagctttcataaactgctgaaatagaatgattaaagaatggtttgttgctgtttttttgtttgtttgtttttgttgagatggagtttcactctgtcgcccgggctggagtgcagtggcgcaatctcggctcactgcaaactccacctcctgagttcaagtgattctcctgcctcagcctcccaagcagctgggattacaggtgcctgccactacgtccagctaattttttgttatttttagtagagacagggtttcatcatgttggccaggctggtctcgaactcctgacctcgtgattcgcccacttcggcctcccaaagtgctgggattacaggtgtgagctactgtgcccagcccaagaatggttttttatactcaa

SEQ ID NO: 105907 - DNA, 330 bp, Homo sapiens
caggggtgcatatgtgagctctttgtcaggcatcgcaaggagtgacagtcaccacttgctgctgttattattttgtttttcccaaactcaaaaatatcaatgagcactccttaccatgtgtgaggcactgggttaggtagtttcttacaaaatctaacattttgaagagacagaaggtagcacacaagaatcctcctagaggtaagacccacctgtgctgaaagatccccaaagccgcagcacaggcgggagcaggccaggatgagaacactcctgctcgcttcctctactgctctggatctgcgtgttggggaaggaatgagataccta

SEQ ID NO: 105908 - DNA, 398 bp, Homo sapiens
cctgagctttgtaaccatatctacaacataagtaaacacctgacagatcttccaccatctgactttgctgttgctccttatcgaagtacgggtaccattgagcatgagtttctgtgtcctatcatgttgggagccaccagtcccccgagggctgaggggcaaagaagataaaggtttcagggtggggttgaagactttatgactgagcagggccccacttcagaagccggagggccccatcccagatctgtttggtcttcatgccatagatgatggggttgagcatgggtggcacaaccaggtagaggtcagctagaaggatgtggatgtgccggggcacgtgctggccaaaccgctgtgtgtagaaggagaagagtcctggtgtgtagaagagaagt

SEQ ID NO: 105909 - DNA, 358 bp, Homo sapiens
ctcacggcaataatgatcaccacacttccctttattgtgtgttttgctactcaaaccacacacctccctctaggacaggaatgaaccgttactactcagagaggggaactcgcccaaggcccacagctggactcactatcctctctgcctgccccagctctcagtggatgtcaaattcttggctaaatccatcagcaatggaaagttggttggccctgggaagaggagaggccggcggatggctaggtccaggactggaccaggggggatggggtcccagatttccaccctgcattaggagctggcatagggactgtccccactgcacagataggtaagctgaggtttgggaaagggg

SEQ ID NO: 105910 - DNA, 727 bp, Homo sapiens
gctgatgtggcctgctcttatgaggggcagtcagtagggccaatggacagtggggacagggaggtcgctttggcagcatctgcctggcactgcccagggagggggtctccagcagccaacatgaccatcctgcctgctgggggggcatgtcctggggtggtgctggcagccatctgcccagcccaacatttattagtagtgatcgtgtgttccaccctggaagcgctcccagtgcactggggaagtcacgtgccctcgcactgggtgatatgaggtttgataggaggagctctaagtgggtggaggaactcctaatactgctttgaggctcaaggaagtcttctcagaaggtctttagactaggtcttgagggaggcctaggagttcactaggaaagactttccagagaaggtgaaattgggttgggtcttgagggatacaaaaagttcactcagaaaacaagagaggaaacaccttttctggacactgggttctctctaggggctcatgtaggccatcagaccagtaagaccacagtattccgggaccctgctcacccatgccagcctctcctgtacgccctgtgtgtgaccgtatgggtgagggcccctccactgccccatcctagagcggttgggattgtgccagtgtggagtgtgctcggcacacagcaagtgcttggtcggagtgggctctcagaatcgtgcagctggtccgaggtggggcc

SEQ ID NO: 105911 - DNA, 329 bp, Homo sapiens
attagaggatctacgggagccttacctcaggcccacatgaacagggtcacagccctgccgcccacaggcccggatgtgggcctcggcacatgtggccggctctagtttcaatctgctgctatggagggctagcaaatgcgtggggcaagacccgggccatccccaggctatgtcattcctgggcccacagggagactctgcatccagagctgcctctgtgggactctcaagcgggatgttttacactcaccatctgtggtcttcaacacaacccgtggtgggacagcagaatggtcccgtgaaggtaagagaagtcaggaaaggttaaa

SEQ ID NO: 105912 - DNA, 745 bp, Homo sapiens
ttattatcaaacatgaatttatttagaaatgaaataaaaacatgctatttgaacaaactttttttataaagaataagttgactgaaaagcagttttaaataacatgaactcacaaatgacttttagaagccaaataaacatttccattttagagaacagtatgtaatacataacttaaaagcatatagaacacatattcatacattcttaaaaataagagattgttattccacagagaatttttcaaaaatctaaagtatgtcctgtttaaccaacaatttgcttccaaataggagtctcttttgagaagctaaatattaattttcaaacaactatttctccatttggtaactggaatcagccatattaatatacattgacataaagacctttgttttaatatgaatgattccagttaccaaatggagaaatagttgtttgaaaacaaaggtctttatgtcaatgtatattaatatggctgaaggctccagccctgagttattttttttacttccttaaattcatatttacaacatatatcaatttgaggtatgatgacaaaaacagaaacaaaagacacaatggtagatgagaatctatctccttgtggaagaggcaaaattagtgtggacttcatttttctgacctataaaactaggaagtataatcacattatctgtgacaatttttccttctaaaatgccatgaatttgaagatagacttcatgcctttctccatcatatc

SEQ ID NO: 105913 - DNA, 2194 bp, Homo sapiens
tgaaggtcaggcaggtcaggtgatttgcccaaagtccgcactgtcactaaatgaacatagattggtatgactcccaagcctgtgagtttttgaccatcatattctgcctcactatgaaaagtttatttaaattaatttttttttaatcaaaagaagtagtatatggagagagaggtgaaaatccatgtttgctctctgcagtttccagaccattcatggcatgttatttttgtactggatatagtcattttttaaaatgctacaaactgttcaaaagagcatgaacaacatgataactccttataattttgttgtaagacaaatggctaaaagtatgtgggatgtttaatttggataagtggaaattctatcacttgataagctctcttgaagaataattatttgaaagattggacttaattctgtattgcctgaagtgtaaatcagaagtcaacaattagattgcaaattatgaaaagcataacttttctaattgtttagtctttttagagaaacaagcccaggaaaaaagtaagattctcattcattggagataagatttctatttatcaaagatacttcagaagagttagatagcaagtaggtaaaatgtcttttaaaggtatctgacatctttaaagctctgtgatttttaaattcttaattttgttacagctaatttttttaaaattaattgctgagtcatggtcaagtatttctgatgacttacatgctgtctttgatacattttaagtttctaaaccaaaactactatttaattctgttaccctgttttagaaaaacatttgagttatacaacttactaaaaggtattttagcgatgatgttttggagcactagtaatatagtgtttaacttattttctattttttatccctctatattagtgaaattacttctctttgaagttttcccccagtgataaaaaaaggctgagcagtatctgtaaaaatttttaaggtggtgtccactaggtggagatatgtgctacatttccaagtgttgtaattaaacttttattagtctgaattaaactcttttattttttataatcatttatatctatttatcataatgttattcaaatgtttcctgagttgtatgaagctaagatacaggtaaaaacaaaacaaaacaaaaacctcactttgtgttttgtaatcattagacaatttaacctaatatatcttcccatatgatatgatcttttcatatggcatacttcattcatatgacatagttagaatcttttcccacaaacaatgagtgatgatatctcatttgaaaactcgtgtaacattgtatcagccactgttataaagtgatttacccatgttagtctcataacaactctatgagatcagtaccgtacacatggggaaacttagtatagagaggtgaagtattttttccaagattacaaaatagctgtctgagctgggattcataaccaggcagcctgactccaaaatcaatattcttaactctattgatatgatggagaaaggcatgaagtctatcttcaaattcatggcattttagaaggaaaaattgtcacagataatgtgattatacttcctagttttataggtcagaaaaatgaagtccacactaattttgcctcttccacaaggagatagattctcatctaccattgtgtcttttgtttctgtttttgtcatcatacctcaaattgatatatgttgtaaatatgaatttaaggaagtaaaaaaaataactcagggctggagccttcagccatattaatatacattgacataaagacctttgttttaatatgaatgattccagttaccaaatggagaaatagttgtttgaaaattaatatttagcttctcaaaagagactcctatttggaagcaaattgttggttaaacaggacatactttagatttttgaaaaattctctgtggaataacaatctcttatttttaagaatgtatgaatatgtgttctatatgcttttaagttatgtattacatactgttctctaaaatggaaatgtttatttggcttctaaaagtcatttgtgagttcatgttatttaaaactgcttttcagtcaacttattctttataaaaaaagtttgttcaaatagcatgtttttatttcatttctaaataaattcatgtttgataataaaaaaaaaaaa

SEQ ID NO: 105914 - DNA, 446 bp, Homo sapiens
tgagacagagtctcgctctgttgccaggctgtagtgcagtggcatgatatcactcactgcaacctcggcctcccagtttcaagctattcccctgcctcagcctcccaagtagctgggactacaggtgtgcgccatcacacccagctaaattttttaatgtattttagtagagatggggtttcaccatgttggccaggatggtctcgattttatgacctcatgatctgcctgcctcagcctcccaaattgctgggattacaggtgtgagccactgtgcccggccctgactccagatttttaaacaaagcttcacttccttaaccaattacaaatcagaaaatctttgaatctacctatgacctataagtcaccctccaggcccccactccaagatattctacccttataaagctaaaaccttcttgtattgatgtataattttgcat

SEQ ID NO: 105915 - DNA, 616 bp, Homo sapiens
gagagatctgaaagtcatttttttctgttctgtattttaatgtttgtaaattctccaactccttacagttctttcaggattcttagggcaacagttctcaaggagtagtccaaggagttctagatattgagatttttttggggagtgatctgtgaggtgaaaattatttttgtaataatattaagatgttgtaggccaggcgtggtggctcacgcctgtaatcccagcactttgggaggccaaggcgggtggatcacttgagttcacgagtttgaaaccagcctgggcaacatggcgaaaccctgattctacaaaaaatacaaaaattagccgggtgttgtggtgcacacttgtagtcccagctacttgggaggctgaggtgggaggatggcttgagcccaggaggcaaaggtgcactgagccaagattgcaccacactgcactccagcctggatgacagagtgagaccccgtctcaaaaaaaaaaaggaaaaaatacattattgccttttggattgtcttgacatttgtactggtggcgcaaaagcaagaatgggtaaaactgttggtgccttagcagaaatcaaggtattggctccaacctctctctctctctc

SEQ ID NO: 105916 - DNA, 266 bp, Homo sapiens
cagccacccaaataagcaataaggattaagttatcaaaacagtggtatagtcatgcaccctttggatctaggctttgggtgaggagtataaggaagacatcaccagaaatcacgtcatccttaacatcagactgcatgggaaaggtagggcagggcatggctacttcctcatccagagctcagaccacagcacctgcagcatactcagtggacactctggagttgttcagatggtgcttggtgagcagctctactattcaggggcc

SEQ ID NO: 105917 - DNA, 392 bp, Homo sapiens
aggagacctaaaataaactgcctgccccataacccggtgctgctggtgtttgttgacctggggtatcccactgggaggatgtccaatgtggaaacacacctatgggcctagagggacccctggtggccctcctacctattcccaaggtgtgaaacccatgaacatccgggggaaatggtaaagatgccttagtctatgaaatattgcatcacagagggaaacctgactctccagtaagcctgatgagctcagatgaattgtacacaaccatagagacttgaggttgtagattatctcttaggtagcaaacagaagatgtggtctgctaagagaatactgtagtgctattttccaattgaattttatataaaattagaaattcattaatccgg

SEQ ID NO: 105918 - DNA, 770 bp, Homo sapiens
actgaacaaaatcatgtaactgaagttaatctttcataagctcttgaaattatgaatcttgtttagagaaaaactatagtttcatgagctttttaaagcaggatattgttattttagttatatagttatctttttttggtaacctaaagcaaacagtgaaaaattgatttttttatttttatttttagacagggcctggctctgttgcccaggctggagtgcagtggcacaacctcagctcactgcaacctccacctcctgggctcaagtgattctcctgcctcagcctcctgagtagctgggattacaggtgcctgccaccatgcccagctaatttttgtatttttagtagagatggggttttgccatgttgtccaggctggtctcaaactcctggcctcaagtgatctgcctgccttgacctcccaaagtgctgggattacaggagtgagccactgcgcccagccaaatggttttacatttctttatctataaagtgagggaattagacaagttgatttctaaacgatttttcaatattgaaattaaatgagtttaacatgataaattattgtgtcatgctgtgggttgatttagtgtttttaaaagttaaatgtttgaaactaatattttaatatataaatgtttttaaagatagctctatcatttaaaaattatgtttaatatcagtaggtttaatataacaaatttatgaaaacagaaaacatggccaattttaaatctttattaactgaaacataagagaatgt

SEQ ID NO: 105919 - DNA, 467 bp, Homo sapiens
gctgcaacctccgcctcacaggttcaagcaattctcctgcctcagcctccggagtagcagggattacagacatgcgccaccacgcccggcgaattttctgtatttttagtagagacagggtttcaccatgttggccaggctagtctggaactcctcacctcatgatccgcccaccttggcctcccaaagtgctgggattataggcatgagccaccatgcctggcccgtttatttcttatatgggatattcctcaggaagttctacctccctgggcctgatgcaataggaaaattaggaggacaaaggaagaggggaatgaaaaaagtaaggatacagaaaaaataaaggcatattgattctttgacttagtcctttgcaagacatgataatgttactagcatggaaagaaatcccatataggcatttgaaacagaagtagattgtgttttgtatggaaaattccctg

SEQ ID NO: 105920 - DNA, 378 bp, Homo sapiens
agtagctgaactagaggcgcgcaccatcacgcccagctaatttttgtatttttagtagagacaaggtttcgccatgttggccagtctggtctcgaactcctggactcatgcagtctgcctgcctcagcctcccaaagtgctgggattacaggtgtgagccagtgtgcccagcctagcttttctttctgctgtggatgtgcactgcagttgttttcagttttgggctattaggaattgcactgctatgaacatccttgtttatgttgtaggggagaaagatttctttttctttccaatggctaggtacatggctgacatcctatcacaaaagacagattaacaagagagaagcatacgaatttattaatataagtttta

SEQ ID NO: 105921 - DNA, 943 bp, Homo sapiens
ccttaatgactggcatcacgcacaaataggcctttcagcttctgaacgcagatattttcaaggaactctgaggcccaggagagcctaagtttttctccacggaagggcaaactactagcctcccccgcttcccctctgcgttcctgcctctttctagaaggaggctgagagggggaagcctgaacccccaaatcaagtccgccttctttctctgtgcctgacccagggcaaaataatctctctgatcctgttcttgaccattgaaaaagcactttctctggtcgggatactactggcactttacatggggggcagtttaaccgcaggagtccgctttctgaaaggtgcagagggaggggattccgccaccagccgactgagaggagccccggccccgcgtggtccctcccagccaccctccctctgggattagctgccctggctctgctctaggcgtccccagcccgtgcagtcccggctggcgcaccaccatcgcctctgcagagcgcggccgcagcccggagcccgcagcccggagcccgcagcctggggcccgcagcccgtagcccgcagcccgcagagccgcgctgtccggggcatcccagtgcacggcgtccgtggacctgggacctcgaacctgggacgggcggaaaatccactgggaacacttgcatttctgtaggtgcttatttcacattcttgtcttttcttgcttgctcgagctgttcgtgggttactttctgccttagttaaaccaaaagggaaaggcggaagaggggaagccctgaagaatgatttagtggttgcccagcctcctttccaaggagaggtgttcgctgagcggctctccccgtccccgacactggcccctttaagaagccaagtcagtcctgatgctgctgtttgtattgctaatccccaggagccccgtttaaaaaaaaaa

SEQ ID NO: 105922 - DNA, 151 bp, Homo sapiens
ctgccctagccttctgaagtgctgggctgtgcccaggcaagtggttcattttattcatctttgtaccccataaacatttactgaatgaatgaatatgaaggtgtcaagattactgattggagacatgaggaactaagcagtaaacaaacag

SEQ ID NO: 105923 - DNA, 308 bp, Homo sapiens
aaaatcataggaaaaattagccaggctgtgtggtgtgcatctatagctctagctactcaagaggctgagaggcaggaggaacacgagtccaggaatttgaggctgcagtgagctatgatcgtggcactgcactccagcctagatgacagagggtccaaacagagcaaccagacagaccctgcctctttatttttgagacagtttcactctattgcccaggctgtagtgcaatggcatgatctcggctcactgtaacctctgcctcccgagaccctgcctcttttaaaaaaaaagaagggaggaagaga

SEQ ID NO: 105924 - DNA, 431 bp, Homo sapiens
  misc_feature (299)..(299): n is a, c, g, or t
  misc_feature (331)..(331): n is a, c, g, or t
cactcaagcacctaccccatcccatctcaagctttaactcctgctgttcctgagatccgaaataccttcccatctgccttccacttagggatactgtttcttgttcttcaaggtccagctcaaatcctaccttctcctgatagcttccctgacttctaaattttttctccattcttgaccccctgacaaagaatcaaaatcatggctcaacaaactgctagcttctgtctcacaaatagtaactttgtcttctcaattagattaagttcttggtggcatttcatttataaccattattntgcctctagatcacgtgttccatatttttcanggttgacactggcctcagtcatgaaactgtccttgaaatgcccatacttctacatctcccagctgcttctcataaagtgacatacaaattctttctccaa

SEQ ID NO: 105925 - DNA, 151 bp, Homo sapiens
gaaactcaggcacagagatgctgattgacttccctaaggttgcacagcccatgggcagcagagctgggagaagcagaggtctgtctgacttcacagcaatgggactggaagtcactttctcttgtgagcctccttttctgcatctccaggt

SEQ ID NO: 105926 - DNA, 362 bp, Homo sapiens
ttggacagactcttgctctgtagctgaggctggagtgtaggacgtgatctcggctcactgcaacctccgcctcctgggttcaagtgattctcgtgcctcagcctccagagtagctgagattacaggcgtgcaacactacgtccgactgatttttgcatttttagttgaaacagggtttcatcatgttggccaggctggtctcaaactcctggcctcaagtgatccacccacctcggcctcccaaagtgttgggataatgggcgtgaaccacctcaccgggccaagacggcttttttgatacaggtaaggaaaattaaatctacagaagcacctaatatatcttaagaacaacctcatttcca

SEQ ID NO: 105927 - DNA, 147 bp, Homo sapiens
ctgaactggtgctttcttctctttggctatgcttgatcctcctaccttggcctcccaaagcattaggtttacaggtgtgagccactgctcctggcccgatgtgtttgtctaacaatttttttttatatttgagatgaagtctaactc

SEQ ID NO: 105928 - DNA, 419 bp, Homo sapiens
tactagtggacaataaatttcactcaggattctgatacctagagttaaaaatgtaaagtaatgcccttccaaaatgttgtttttgttattctttattattgtaatgcataattccttgtattttccatatattaatacactcttcccaatgacctaaagagggagaatttatcaatatttcttttatgtatgaggacattgagacttaggaaaatatgtaatttgaccaagattgcacagctactagacgccatttgactaacttattgactccatataatgttccaggcacattactgtaaaaattacaaacttacagcacatccgaaagtatcatataatctacactttttattaacgagtaggtcctcgaatgtccaactggcatagaaaagtgcttaataaccacatcattacct

SEQ ID NO: 105929 - DNA, 512 bp, Homo sapiens
tcgactggatggatgggtaagctgctcctgcctgaggtggggagccccgcactcaactcagatctaaagggacaatcgtggactccgcatgggatgtgctgagtttcagatgccctgaagtatacaggaggaggtggggcagtggccttggaaaacaggtctgtagtcaaaagaggcctggggtgagatgtatatatcagggagtcattgaggcacctgggcatgtgggcaggggtgaagtcacttagggagagagcttggcaggagaggaggggctgggtttcagccctgagaagctccaacctcaggtgacaaagtagaaggggatgagtcagcaaaggagactgaggaggggactgagcagcaagacgagcaccaggagagggtggggacgttcatcaacaaatacttattcagcagatgtcgagtgctattggggaactacaaaagacacaggcactgttctggaactttccatctttggtggagaggccaacatccacagtcaacag

SEQ ID NO: 105930 - DNA, 813 bp, Homo sapiens
ttcagacaaagccatatatgattgaaggttatcagtactgtgcttttggaggattcagaagaagttatatctgattgggagattgaaaaggattggcctgaaggagaggtggtttttgaactgcatcttaaaggatgaggaaactgaggctgagagggtagagaactttgcctgaggtcactcagcaggtaggtggtggagccaggggtgtaacccgggctgtgggcctccacatcagatacagacagaacaggaaggtgttgcagaggctggcgatgctgcgattctctgggtagcaaagggaggggacattcccagcagaaggaacggtttgtgtaaaggtgtggaggtgtgatacggtgtggcctgttcagggtggtgactaacagtggccagagtgaagggtgtgtagagaggagtgccagcagatgaggcaaggggctggggactggggccaaggtggaagaacttcaggttccaggccaaggaaatgaactttgtccttgggtagaggggtgccacaggaggcattgaacaagagtgcaaccttgggtttgtatggtgagcctccagcaataccttggcaggtgggatcctcatgtccaccccgggtgccagccacattttacaggctgggaaacagaatggttatgagaccggctcagaccacacagcaatagacaactggccccaagccagttctctcgttgtcacaggacgttgcttcgaaactcaggtcatagtgagaaaggcaggggcatccttccgttcctcacttctccagccctgtgcctgctcagctcactggagaac

SEQ ID NO: 105931 - DNA, 302 bp, Homo sapiens
agagaaatcctccatcctgttaatggcttagaagtgcattttactgagtctttcttcataaaaacgatattctgaatgttggtgacattccttggccaatccacataaagacagtcttataaaaatcttaatttatctttgtacattttcatattatagctactgtcttaggtttattgaaataggtacataagaatggtataaaatgtcataatctctaggttagtctcaaaaatctcattacttcgttttcgttctcaaccaaagcaagcatatttttctggacagtttatggtaatgag

SEQ ID NO: 105932 - DNA, 409 bp, Homo sapiens
actttgaagaagttattatgcataagttcaaagagttaaattgcatgcaaagaattgaaggacaatatggtacctttgacttaagagcaatctcaacagggagatggaaactataaaaaatggaaattctggctgggttcatggttcatgcatgtatgcccaatgctttgggaggctgaggcaggaggatcacttgaggccaggagttcaagaccagcctgggaaacatcacgagaccccaagtctacaaaaaaattaaaaaattagccaggcagggtggcatgtgcctgtagtctgagctactctggaggctgaggcagattgtttgaacccagaagttaagggtcacagtgagatgtgatcatgccattgcattctagcctgggcaacagggtgagaccctgtctct

SEQ ID NO: 105933 - DNA, 457 bp, Homo sapiens
gttccaagtagcagaatttcctgctttttaaaggctgaatattattccattgtgtgtgtgtatatatatatcacatttaaaaaattttattcatccattaatggaaaaccttcattcttgaaaaaatagcttataaagctatttatgtccctgatacctccaaagatcagaatgagtaataatctcacaaggatgggaaatacttcctctcttccaccttttgcatgtccatcctttgaacatgactcctggtgtgttagtctagtctgttctcatgctgctaataaagacatacctgagactggctaatttataaaggaaagaggtttaatggacttcacagctccacatgactgggggggcctcacaatcatggtggaagacagaagaagagcaaaggcacatcttacatggtggcaggcaagggagcatgttcaggggaactcccctttataaa

SEQ ID NO: 105934 - DNA, 396 bp, Homo sapiens
agagctttttgaaggaatttgattttgtgaataaaagttaggattatcactaaaatataggagtcattagaacaaaaataaaaacgttcactagagtcactaaccattcttaagctacattttagtaagatttaactataaaaattattgtatctttttagaaatgtaatttaggaattaggaaaaacaatttgcataaagacctaaaaacatattatacactatttaataactacattctttctcagtgtttgctgtcatcgtgtaaataatcacagctcttttgacaaactaacaagtatcatttattagagagagtgcaatggacatatagctctttaacttgtttgattgctattaggagcagtcataattcatttaagcttttagtttgac

SEQ ID NO: 105935 - DNA, 592 bp, Homo sapiens
cgacaacaaaaacaacaaacgaaaaggaaaaggaggaagtcaaattatctctctgagaaggatatgattctgtatctaaaaaaccctaaagattccactaaaagactcctagacctgataaatgacttcagcaaagtctcaggatttaaaatcaaggtacaaaaatcagcagtacttttttttttttttttgagatggagtttcgctcttgttgcccaggctggagtgcgatcttggctcaccacaacctctgcctccccggttcaagcaattctcctgcctcagccttcctaagtagctgggattacaggcatgcaccaccacgcccggctaattttgtatttttaatagagactgggtttctccatgttggtcaggctggtcttgaactcccgacctcaggtgatccgcctgccttggcctcccaaagtgctgggattacaggcgtgagccactgtgcccggcccagtcagcagtactcttaaacgccaataatgttcaagctgagaaacacatcatcaagaatgcaatcctattaaaaatagccacaccccccaaaaaatgactaggagtatgtctaaccaaggttgtg

SEQ ID NO: 105936 - DNA, 378 bp, Homo sapiens
tttgtggttacagtgagctatgatttggcccattgcactctagcctgggtgacagaattagactctttctcttcaaacaaacaaacaaacaaaaacccaatcattttctgggtttctttcaggatgtaaaacccttccagattattaccttttacctaactaaattctggcaattttttttcttttttcccggcggggatggagttttgctctgtcgcccaggctggagtatagtggtgcaatctcgactcacaacctctgcctcctgattcaagcaattctcctgccttagcctcctgagtcgctgggattacaggtgcttgccaccacgcccagctaatttttgtatttttagtagagatggggttttgccatgta

SEQ ID NO: 105937 - DNA, 661 bp, Homo sapiens
ctgacagtgcaggaagaggaaaacccagggacagaggggtgcaggactcgggctctggcacacaaggaggtagctggtggtccaggcaaagaccccaatcacagggaaaaaaggcttgttcctacacacagaaaattaaactggccaggcagtaagaagaaacacagggtcttcctcctgctcttggtgtgaggatggtctttcccaacacagagccctgaggggcagcctgggcgggcatctgggcccccagagtttgggtcctcaggggctgtccagaggccagggacaggccaacgttcctgggtgcactgagtgagcagcagtgatgactcttgaggcctggggtgtgggaactgccactgagtgaccttcccagcagcccatagaaggccctggaggaaaacaccccacttacaacgcaccaaggagaatgcccaaaagcccaggataaacccagtgagagagcagaacttgcacagtcagagctcaggcccggcattcaactatttctggttgctcaggtgttgaccaaggcctgcagcagctgggcctcctgggatcctcaccaaggaccggctctggtgctcagggcgtctcctccctcaggaagctgagctcatccggaacattcaggagctgctgaagagagccatcgtgc

SEQ ID NO: 105938 - DNA, 286 bp, Homo sapiens
taccctcagaaaaatatgttgccagattcgatctttatcatcagcttgcagagtcctcaagagtgtttggctagttttgtttataaaaatgtcccatgagacatttgcaggtctatttttcatttaaattgggtgggcaagcaggtaaaagaagttcctaaagacatgaacttctatagctcaatgaataataaccacaattaacatttattgagcatttactaagtgtcagagactgtgttaatgccttaaatggattgtctacttcaattaactctatgagtta

SEQ ID NO: 105939 - DNA, 118 bp, Homo sapiens
agtgggtgcactggtgatctcggggtgcactggtgatctgggctgaacctacaagcctcaggctgggcacgcaccctcaggaccgtcatctcctggaactatcaggcagcctggatca

SEQ ID NO: 105940 - DNA, 328 bp, Homo sapiens
tgaattttctaagaattgattttgcttcctttgggaagtttcagagtatatgaatgctcagtttctcttaagcccaaagataatttagaagtcatgtttctgtggaggtttctttccccattgtgagtttaaatttggggcggcttttaatgctcaattagaatacttcttatggttaagtactttctattccaaaaaacaaaaacacctctcaaatcctctgcacaagacctgcctttgaaaacatctggtaaaaataacaagtcacttggaaaactgtgattctcaaatggacccccgcctcttggttagtgggaagtcactgggg

SEQ ID NO: 105941 - DNA, 341 bp, Homo sapiens
tgagcccttcagaatcagattttgccccttagtaagcgatattgtcccactgagaatgcatgattcattgatacataaatgattttggacactaacaacagtagttgcagcagtgaagcaggggtcgaagccaatctgcattggactgaagagtgagtttgaagtaacgaaatggaaccagacatgtaggtcatttatagcagaatggttgcaagaactgcctcagcaatctggcctctgctctcaaacctgcccctgactaacaaggcaagctgctttatttgtgtctcagtttccttcttcatctgtaaaagtggaataatagtaactacctcataaag

SEQ ID NO: 105942 - DNA, 336 bp, Homo sapiens
cttccagtttcgccacagtccctggcgtccgtcggcctgtagatgtgtcaccctgacctcagcctctgtcttctcatcaccttctcccctcagtgctcctctcttctcttctcttccaagtacacttgtcccagaatgatctcatctcgagatcttcaccttaacaccatcggccaagaatctgtttgcaaatgaggccatgtgcacaggttccgggtggaggtatctacccagggaccactgttcaacccagcagagcagggacggggttaagtgggggcgccctgccctccgatcacagtgtctgccttgcggagactggattggggacttggg

SEQ ID NO: 105943 - DNA, 380 bp, Homo sapiens
atgctttaggaaatggaacttgcagggctggaggagaatgggtgtgagtctagggtcagctcaggcagcattaaacttcagcagcttattcctgcaaaacagtggccttgtggtgagctgttcattggctcttgattttctgctctgtgctctgctcatcctgtgctttcagctgatcccagcagatgcagtataaattgatttctctgtaattagatcagctgcagcagggaatacctatttccatatgtaagtgttaataaataaaggctggatgtgtatgtttgggtggtggtgccctcttagtgcctgtattccagtggtagctcatgctttctttgctgtcggtattttggtctttgcctctggcacatctgtag

SEQ ID NO: 105944 - DNA, 132 bp, Homo sapiens
cccacctcacactgggccctgagggtggtctggggggccatgggaaggcttcagctctatggttcccaacctgccacccagcgcaaacctgcccacttccccttctcgagccctgcagagatgctcacccct

SEQ ID NO: 105945 - DNA, 703 bp, Homo sapiens
gtgaattactcttgatggtactaccatagataaaaaagaataaagatgttttgattacaaaaaagcagtttaaaaaaatcactttaaattgtacacatttaaaaaatacttagtagtctagattttataattatttaaaaagttaattgtaggtaatttataatctcagtattgtttgaaaaaaattattatttaattatcgttcctagtattctagatgacctttttgtgtaaataagaaaacaaatttttaagttattatgttgtatttttttaatagtcacatgataatgaattagactttttatataattagaacttctatttaatttgtaaaataaattctttgcaattactaaatgaatcaataattacagttggcccttgaacaacatgggatttagtgctgccaatccccatgctgttgaaaatacatatttggtatgttatatatattatatattgtattctgagtacaagaaagtaagctagagaaaggaagattttgcagtagttaaagctgtagtttccttgtagttcgatgcttgaactactatcaatctagtgtaaggtgttcacccatccacggtaaaataaagtaaatttactccatttactcattttaaaatgttggtctttttcttgcctgtatgccttctttatttgttttacttaattttttatttataaaaaaacaataata

SEQ ID NO: 105946 - DNA, 396 bp, Homo sapiens
aattatacaaccctcccccaaaaaactgcaaggagcttctacagttgagtattgaatttaggatttctgatagcccaagccaaatggagtcaagggttccctttatctatttaaatgaagtataccagatagccaggtgcaaagagcagttcctgccatctaagaaattttcactccatttgaggagatagcacacaaaataaataatagagtaaactggcatgatattgttgactaaggacggtagacaatacatgattgaaaaacatactgagcattaaactagctagcttttaggtcttacactgaaacccctgcatcatgcagaccaagatggttctactgacaattgactactagaggaaaaaattaagcatttgttaagaaactagatta

SEQ ID NO: 105947 - DNA, 872 bp, Homo sapiens
ctcaaaccaagggtgtccaggcaagacagggaggtggcatgggaagggtggaatgggccagatcaggaagggatgacatgcttagccttatccctgtggtcacacctgtgatgcagggaggtggctgagtggtgcaggacagcaattggagaagacaagaccagcagcaggcttggggacacccagactatgctgaggcctagagaggctgggctcattgctgggaacccaaccaaaggggctggtcatgttcccctccaggcctaggatgggggcttggataggcggtgcctctacagcgtcccaagactgaatatccaggtagagcctcctactttctctcagatgctccagtctcactttcccttggccctggactcctctgggaagcctttcaggctgctctgagttctggcacaccttccacttagtgcccctggagttgttctgcctgcttttgtgtttcctggctgccagctccactgggagctcccaggccaggcctgggcgcctcccattcctgtccccagaaggagcactctggatgggaacttcccttctctcccaggggctggggcagcctgggtgatgagaggtgggatcaggaggggtggcaccacccccatctggcccagtaagttccaggtggggtggggctggaagagagggactcatctgagagggtgggggcagggtcctgctacagccctgagcagtggctgtcagctgaagccacccgcttcctctccccccagcctgctccagcagggctccctcctcctcctttgtcctccggggatccccagccccaagggctgatgggggtgcgggaggaggcggtgtgagccccggttggggggtgtcttcacccc

SEQ ID NO: 105948 - DNA, 428 bp, Homo sapiens
cagagatctatttacaagataggtttttcatggtgttaaggttttgtggtgttcaaagataggaaaaggaagttgaggcagtgcagtatatgctgtttgtctcattaggttattaactatttgaggttagggataatgcttttccttaattgacaatgtcatgctctatataatgtcattatttaatatgactgatggaaatataaaatataaaggtacactatgactcactgaatctaagtttcacagttttaatattttagcatttctaaaattggatagaggtcttacaatatatcgtctttggccaggcatggtgggtcatgcctgtaatctcagcactttgggaggctaagacaggaggatggcttgaggccaggagctcgagactagcctggtcaatacagtgagaccttgtctctacaaaa

SEQ ID NO: 105949 - DNA, 379 bp, Homo sapiens
ggacagttaataactatgtctgatgagtttagttgtgaaattaagccacactgacataaggagccaatcgaaaggacaccatctagtctatgtgcaattctgtagagaaatcctagtagttggaattcacagtttagcagagtatcattaaacacccatcttttgggctgggtgcaatggctcacacctgtaatcccagcactttgggaggcagaggcgggcggatcacttaaggtcaggagtttgacaccagcctggccaacatggtgaaacctcatttctactaaaaatgcaaaaactagccaggcatggtggtgtgtgcctgtaatcccagctacttgggaggctgagacaggagaactgcaagagcctgggaggt

SEQ ID NO: 105950 - DNA, 403 bp, Homo sapiens
aagttttctgaccttgtaagacgtagggtgtatgggcctagatgtttgtgatacctgtatctgatatcacaaatacaacattttaagaaatctaaaagtaaatatgcctttagataattttcagtatgtggcatttgggaatgttatatactttttttttttttttgagacagagttttgctcttgttgcccgggctggagtgtgatggcgcgatcttggctcgctgcatcctccacctcatgggttcaagcgattgtcttggctcagcctcctgagtagctgggattacaggtgcctgccaccacgcctggctgatttttttgtgcttttagtagagacagggtttcaccatgttggccaggctggtctcgaactcctgacctcaggtgatctgcccatctc

SEQ ID NO: 105951 - DNA, 279 bp, Homo sapiens
gactctcaacgtccggagcactagctggctgaggaccacacggtccgctgcagtagaaagctgtctctctgctctaaagatgagcgctgacatggcagggcggggccacacctacagattatcaagacctcaggagttcgggtttttaaaagtggaaattcccccaattaaaaaaaatggcatatatttcaattaaaatactgcatgggccaaagaaaacacaacggccagccagacctggttcctgtgccactgctttgctgtctgtgatggtgaata

SEQ ID NO: 105952 - DNA, 432 bp, Homo sapiens
agctgttcccagcaatggggatcagtcaccaactcctcccacctcctccttctcatgcttcactcttctgcaccaccccccgcccaattttatagtcttctcaagtttaaagacttcccttgacatgcataaaaccaaatttctcttctggggaccagtgaacacatattctgatttttttctagttcctcgccttaccccattctcaggaaagcccagttacttcgtgagttcagagcacttccttgctggggcgcctgctaagtggggtgagtttcactggagcacccctcccaacttttgggaaagagttcactctcaccaacccatactttctgcctttccttctctgggattgtcttacctctggaaatccttcagggacttctagggaatggctatgtcaatggggctggtaaaaagcagctgtgg

SEQ ID NO: 105953 - DNA, 720 bp, Homo sapiens
ccagctgttacttcctcctcttcaaataagccatacagaataaaggaaaaatctacagaatattggcaattgggatgaccgttggcctctaccttgcctagagaggaaagaaaggcccaaggaccttgagatttcatgtgcagcagcatctgatgggccggttaccttctttgccctgcacattttctctattcctctccccacagctctctgccctgagaggttgacctggatgagctgcacccacaagctcatttgtcctcaggtttccagttgagttccaccaatgggaggcaccatcaggagatgcagacttcaagaagagtgaagctgggatgtttacttccccaactcgctctaccgagctgcgtgtgagctggctgggtacttcggtgaagtttgcagctcccatcggcgcccttttctacatcagcctccgtagctgcccaactttcttttgccattgcagccagttgagtggcaaaactggccccctcaatattttactgttccttgttggcttcattttagcctgtccacacttttgtcaattaccttttctttaaactctcaatcacctatttgaacatgccaccggggatgctgctttgatcctgcctgacaaccttggtttctagtttaatattttctcctctcccctccgccccacactatgctgggttgaagcataaaggaaataaaagattgccttcatggaaa

SEQ ID NO: 105954 - DNA, 260 bp, Homo sapiens
aaaattagtcaccatttactcttcaagcctttcccggaaatttctaagccttcagtacactctagagttccaaaataattaagcagacagattctgccagtacaactgttatctggtaaagggacagatttctggtgcttccttctccatcatctttctagaatcctcccattcttctcttagctttactaaattcttgttcttgttgaattcttaattacatatttatagactccttccttacagctgatgtcttctgt

SEQ ID NO: 105955 - DNA, 287 bp, Homo sapiens
ggagagaggaggggcacaaaggctgaaaaattattgttgggtactatgctcacaacttgaatgacaggatcattgctacctcaaaccttggcatcacaccatatactaatgtaacaaacttgctcattgacccccgattctaaaatttaaaaagatgaaaaagaaagatagtggttgattgtagaattctgtttctgtgtaaatcctgctctgccactttgctagctgtgtgactttgggaaaataattaatctctctatcccttcatcatcaaataaaatgaagac

SEQ ID NO: 105956 - DNA, 415 bp, Homo sapiens
ttcatataagcaggatttttatttgttaagaactgtatgactttgaaactctgtagtctatcttttagagaacttgttatatatgtaaatgaatgccaactgttcaagatttttccgttactggggtggaatttttgtatacgttttggggcaggcaaagtttgagtattatcatctgatgtaatgtgttaggcatgagatttaacattcttggataaattgaaataataccaagaaaatctaaatcagtgataaaatccctacataggtgctgatatttatgttatgttactagaagtgcttattttacaatgctatgatatgtgtttgtgtgtttctcaaaatatataacacttggatatattaggttgctagcattatctgttaattgacatgcagaaacaaatcctaaatt

SEQ ID NO: 105957 - DNA, 415 bp, Homo sapiens
aaactgcctcattcatctttgtatcgttaaggcctagcacatacccacctagtaacaatagaatcaatatgaagcctccaaaataattgggttggaggacagtagtttttatattaaatgtactcatacccacacataaaatagaatactaaggctcattacttagtttcatatttaatttttttcttaattgtatagccatgcatatgttgctgcactataaactaatcataggagtatatagcattgtatctgaagccatcaggtgagactgaggaggaacactttaaggtcctttgccttttcactgtcctttccctccttcccttggtctccccttttctctcctttttccattccttccctcatttcacttgtctagttagtaattttcatacttaatgagcagcttctg

SEQ ID NO: 105958 - DNA, 138 bp, Homo sapiens
gagactgcgacactgcacttcagcctgggcaactaagcaagactctgtctcaaaaaaacaaaacaaaacaaaaaacaaatcaatggcaaagaagccactggggtttcctagttctgacttcggagggtctggcagccg

SEQ ID NO: 105959 - DNA, 379 bp, Homo sapiens
tgtgaaggaggagctaatttcagccctaaaccatagtttctctgactgcccaaggctgtaggcagataaatgtccctctttcaccaggaatctttcaagcaacttggagaaataaaaggtttggtgaggcagctgcttctaatacctataccccagctttgaaaacatatggaattagaacagcagttcttgactggcggtgactttgccccccgccccgcccaggagacatttggcaatgtcaggagacattttcagttgtcacactgggagagagtgtatgtgtgtgtgttactggcatctagtgggtaggggccagggatgctgtaaacatcctaccatgcacaggacagccccctccaccagcacagtggaaaat

SEQ ID NO: 105960 - DNA, 231 bp, Homo sapiens
cctcctttctccgctttgtcccatggaaccctctttcacccagggttcctcctcagcacctcatccacccgtgtgtcccacggagctctcttcctccacctggggttcatcctgagctcctcctcctcctatgtgtcatcctcagagctcctcctccctcgtgagtgtcccatggggctcctcctccccccatgtgtcatcctcagacactccttcacctgtgtgccccat

SEQ ID NO: 105961 - DNA, 391 bp, Homo sapiens
gttctgggggtcatggcccatctgcttggctgtgagccagactccaaggatactgttgctttcactttcctttttacctgtcctctctctttcagctcaggaaaattggattaaccgtgttctcatgtgttttgttggtcacatgccattgctattttctgccaagcaaaaaaataattacaaaaccttaagctgttactgcccccttttaatcacttttctcttgctttaatttctttcaccaccaaattgctttgaagagtccaagtcctaacccctttctccaaccctatcctaatttccctggccagagaaatatcatttttttctgaattgacatgagaatctgcatgtgctcctctgcctcatatgagtgttgcccatcttggtc

SEQ ID NO: 105962 - DNA, 170 bp, Homo sapiens
catgtaaattttatagtaatcttacctatatctgcaaaaacattttgctaggattttgatggaaattgattggtaaacctgttaatttggggagaattttgacatctttgctatgttgaattttttctattccatgaacactatgcctctccttttatttaaaattttta

SEQ ID NO: 105963 - DNA, 442 bp, Homo sapiens
aatggtagcgtaatacctaccatctatgtcttggaagatttcccatttggtaaataaaagaacttcgtctttttgatggacgttcgggctatttccagttctttcggcagtgtttctaggcggtcatttagcccaaggctccccaatctttttcacatcttgacattgactcaattcactcacgctgaggagcctgcctccaagggctgctgttaccccaatccctagctcctgtcccctccaccacccctacagccccataccactctaggcctggaaggattgttatctgggcacacatggaacttgttcatgttacacccgcacaccaaaatacaccagttatgaagctctgagttagccagtaagtacttgttaagggttcattaatgagcccagaactgccctctgaattggtagggaaattgcaaaagattgaaac

SEQ ID NO: 105964 - DNA, 277 bp, Homo sapiens
gtgcctcgctgtggagtttttatctattgtcctgggtcctagagggcccattcatcctcaacacacatgtccttcagtttaagaaaattatcttaaattatttctttccccactttttttttctgttcctatttttggaacttctattctttgaatattggacctgatcttctaattttcttctttttctattcattgtctactttctgggagaattcctccactttatcttctaaactttctactgagtttaccatatctgcttccatgcttggaa

SEQ ID NO: 105965 - DNA, 367 bp, Homo sapiens
aggacacaggaggcagagccgtgaggcctggtcagagcaggtggagtgctagtgtggagactgcagggagagaccacccgagccatcagctgaggactgtggcggcccagcaggagtaacactgttgaggagaacccagcccaagcctgaggaggctggaggtgccatacggctcctgcgtgcgcctggtgtcttgcccacgctcaccgctttcttggtcagggcagtcccggctgcagcctctcactcatcacattctcatctctcatctgtctgatgttcccacctccctgtccagccccagggttaggtgagagcagctactcagtcctggccactgtcccctcccctctgcaggatgacatgc

SEQ ID NO: 105966 - DNA, 424 bp, Homo sapiens
tataaactgggtttgggaaagaataatatggcagtcgggtcagattcactgtatctaaagatcttgctcctaattccgatggcatgtctgtaattgggcccccaatttcaaatttagtccactcttcttttctatacaaggagaggctttatgctccacctgctacatgacccaaatcaataatccaatgcagcagcttggggaaccctaggttttcactatgggaccaaataaactcagaatacttttgagaacttcaatcacatgaaataattatttcagagaaggatccttgtggaaagaccgtaacaggaagagcattctgaggtaacctttcccaactttctcctccacacattcttgcagaggaaattaagagagagaaaaaaattaagaaatcccaacttagtccggactctagtag

SEQ ID NO: 105967 - DNA, 706 bp, Homo sapiens
cacggtggctcatgcctgtaatcccagcactttgggaagccaaggcgggcagaccatgaggtcaggagattgagaccatcctggccaacatggtgaaaccctgtctctactaaaaatacaaaaatgagctgggtgtggtggcgcatgcctgtagtcccaggtacttgagaggctaaggcaggaaaatcgcttgaacccaggaggcagagattgcagtgagccaagatcgtgccagtgcattccagcctgggcgacagagcgagactccgtctcaaacaacaacaacaacaacaacaacaacaaaaaccaaaaacctgtattgccgcagtcatttagatggaaatggggaaagaataatattaataactgatttcaaaaaggacttgaagatatgaatcatctattttgctgaagaaatcgtaactctttgaaattactttctattgctgttgtcatactcttaggtgccaaactgcattaaattttttatcaatgaagtggaagcatgtgttttgtcgttttgggaatttttatcaagtatcttcagagaagattatttcctgctttatcttcaaaaactggaaaggaagggtcaaagaaaagacagtagctggccgggcatggtggttcatacctgtaatcccaacactttgggaggctgaggtgggcgggtcacctgaggttgggagtttaagaccagcctgac

SEQ ID NO: 105968 - DNA, 367 bp, Homo sapiens
agaataactatcacacaccacagaggaataagaggttgaatatgttcaatttctgtctgactattggaagcctcaggtcatcacttcttggaggcagtcctgagtagatgcaatagacactaaggcaaatattatgtgtaccatatgacagttaattcttggaatagctctggaaagtagacattatatgaccattattttactgaagacaatgctacagcaaggatgatttagtgacttatttagggcctcacagtaacagaacctggattgaaattaagtttggtctgagtcaaagtctgctttcttttcattccattacactggataggcttgagagtatattgcagagagaatatggcatttg

SEQ ID NO: 105969 - DNA, 441 bp, Homo sapiens
taatgtagacccagccaatagagtttaagtgatgtgaacaactttcaggaaatatcctctgaggaggtgtgtttgatttgctgccccttctcccttttttgctgcttggaatgcagacatgatggctgcaagtcatcttggaccacaagttagaagacgcaaattgaatatgcactggactacctactttacatgagaataagagacttctaactcattcaagctccttttattttgagtattgaatctaatcctaatttttttgtttctacccccatgtaacctttgcttctttgcataggaaactagataatggacttactaggagaagacaaaatttaatggcctttttttccctagtatataacaaactacttgacacataagagttgccacaaaaagtgtcttttttttttaacttggttaaatataaatatcacc

SEQ ID NO: 105970 - DNA, 339 bp, Homo sapiens
agaaggttaaggctgcggtgagccttgattatgccactgctctccagcctggcaacagaatgagactctatttttttttcttttaaaaagactttttacaaaaggcaaaatgataatggaactaaaaatgtacgttgactgacttaactccaactgcttcttccctcaattgaaaccacctttgcaaaaattataacagtgagaaaattatggcagtaggggtgatctgatcaagccaaaccccatcttgcctttagccttcaagctgcccataattattcctgggcttaggccaagctaactttgggagacacttggtctatagtttaaatgataata

SEQ ID NO: 105971 - DNA, 379 bp, Homo sapiens
ttttttttgagataggatcttgctctgttgcctaggctggtgtgcagtggcaggatcagggctcactgcagcctcaacttcctaggctcaagccatcctcccacctcagcctctggagtagctgggactacaggtgtgagccacctcacctggctaatttttcgtattttttgttgtaacagggttttgccatgttgcccaggttggtctaaaactcctgggctcaagggatccccccacctcggcctcccaaactgctgggattacaggcatgagccactgtgcctggtgcactttctaggttttaataaatagtagtgtaatagagggtgccgcttgaccatccacatggcttgaacttttcgctgtgcccagcaca

SEQ ID NO: 105972 - DNA, 384 bp, Homo sapiens
agcagggcagtaaaatcttaaagctccaaaatgatctcctttgactccatgtctcacatacaggtaatgcaagaggtaggtacttagcattgagcataagtacacttttgtggcacctggggttgtataatgtaagcatctaggtcatgttttaagctttaattataaatgctttcaatccacaagctattttctcttcatagcaaaatctcctttgactccatgtctcacatccaggtaacgatgatgcaagagcagctctgctcctgtggctttgcagggtacagcctccctcctggctgctttcaggggctggtgttaagtgtctgcagcttttccaggtgcacagtgaaagctgtcagtggatctgccattctcaggtct

SEQ ID NO: 105973 - DNA, 394 bp, Homo sapiens
acaatactgaatgtgtcccaccactacctctatcatcattcacctggtttgagcctctcgcacaaggatatccatacccccaggggacagatggaagccaggggtacaggaagccacctcaggataaacccagaacactctgaggatcaaatgtactcaggggcaagaaatgtaaatcattgtcttaaaacaaacaaggctacattatggagtcaaatgcaaaatgcaagtgaaatcgtaagataaaaagagaggcttcaaggcctgcatggtggcttatgcttgtaatcccagcactttgggaggccgagacagggagattgcttgaggccaggagttcgagacaagcctgtccaacaatgtgaagcttcgactctactaagaaaatacaaaa

SEQ ID NO: 105974 - DNA, 473 bp, Homo sapiens
ccgtgtagccaggatgtcttgatctcctgacctcgtgatccacccgcttcggctcccaaagtgctgggattacaggcgtgagcaccggccggcgagaactgttttagaccttataattttagtatgaaagtagtccattttgactggaaatcttattcccgtatgagctgatttttaaatagataccaagtttggcataaactcttacaagtacatcagtattggagctggattgctttttacttttttttttgagagagtctcgctctgtcacccaggctggggggcagtggcatgatctcaactaccacaacctctgtctccgggtctcaagccatcctcccacctcaccctcccaagtagctgatattacaggcgtgtaccaccatgcctggctaatattcgtatttgtatttttttatagatatgggggggggtcttcctatattgcccaggctggtcttgaactcctg

SEQ ID NO: 105975 - DNA, 228 bp, Homo sapiens
cagagtgagaccttgtctccaaaaaaaaaagtttgtttttttttatccactctcctcaccaaacaaactgagtaagttagagccctctcagctggcatgtgttggaaacagtgccctctcattaaagtgctgccctcactcccattgcctcttggccttggtcagtatgatgaaattagtgggaggcagggcaacagagggcagggaagagctagaaatccatggcct

SEQ ID NO: 105976 - DNA, 432 bp, Homo sapiens
cctctgacagactaaaagctgaatccgcttatttcgaactctgccttgaggcgggatgccccgtgcattatggttaactaggacctgctaaccatcggcttatcaaacaaatcaatttcactcttcagctaatttggaaatgaaaattatagaagttagaaaaaatgtgcagaaaaagtattattccaatgtattattccatttgtttcatagagatcctggcttcacaggaaagagccaagggcatgggttttgctgagggcgtaagagcttggggaaggtgagggctaggtgtgtacgggtgccctgatgtcctcttagcctgctggtgaggaaagtgcatgtttaataaatgggctccagccaactgtgtgcagttatttgtagcctgcataattttaaaaatgtggttgagcatttaggtctatcttc

SEQ ID NO: 105977 - DNA, 329 bp, Homo sapiens
tgtggatttttagaaaagactgtgtattggttaatttattttgaggacatcagcaaatttctatttagaacttagtgtctttattgcttttggaaagaataaattctgtgatgtgataatcattaactgagtaggggattttaaagacattttgggtttttaaaaatactctttaagacagaacctcctctgccctgaaacaaataagtgcttaggtgagtacttgctagtattggttatttttaataagatctcagtttgaggagttggagtaggaagaaatcccttccagtatgctttgcagtcttttgcttactaacttacttgcc

SEQ ID NO: 105978 - DNA, 310 bp, Homo sapiens
tggtggccagccaggcgtggtggttgtcgaatctgtggcacctgtgggaagtgggctcagcccagggactgcctttggatcccccagcattggcaccatacctaccctgggccctaaggtggccatgcttctctggatttgcttccctagcaggggctctagtgcttgcccactccctgcccacagcatggcctgggagcagctgagactgggggccagctcatcccgcgtcgattcctggaagtgttatcagtgcctgttatggaggctggacccatgagtggcagccttccctggcagctgggctgac

SEQ ID NO: 105979 - DNA, 284 bp, Homo sapiens
tgctgggattacaggtgtttttctttaagtaatacttggtataagagaactttatatctggaataatttaaatattatctgaccgaatctattattcacatatagaaactcaggttttagccatttaacatctaaagctgttctcatttagaggaaattaccaaaagagtgacttatttaactaacaataaaatctaaggatagatattttttcattctgttgcagagcaaaagcagccttctggatatgaaaagatattacttctttagtgtttattacttat

SEQ ID NO: 105980 - DNA, 839 bp, Homo sapiens
gaaagggtttttaacttggagagaaaactgaagggaatgtgcttgtgttagatgaccagttaaggtgtaccacttagattggaggagggatagcaggaattctaggacttctacccagtttctcatgaaactgacttggacatggtccttttttgcaaagggtttctgtttgcatttttctaggctttctgctggcttgattggtaagactatcactgttggaaatgggtggttcattggacattgtcagtaaaccaaaatgatttttttttctctttttgtagaaagaatctttaaaatgtataagtactacctacactactcctccaggaatattatctcattattgtgaaggaaataagtccttttctccagtaaggttggctaagtccatactagtttttctcacagatgtatgtcattggaccacatttacagtcagtatttgcctaaactgtatgatgactacaaggtctatagcatttagagtaataagatattctaataataccaaatttgaaaagagggttgctcttggaagaaaaagggtgtccaagagcaaagtttgcatactgttactttggataaagctttagcttaccaccagtgagagagacttgactgctgtccctcatttggtcttgaagtcctctcaggactccttttagattattctgaaggagttaaaacagatgtgtggttaccaggggctgggagggggtatggagagtgactgctaatggctacagggttcctttttggggtaatgaaaatgttctagaattagatagtagcgatggttgcacaactttgtgagtatacaagaaaccactgaattg

SEQ ID NO: 105981 - DNA, 341 bp, Homo sapiens
tgctcgctcgcacagtcctttatggaggttaactacaaaataagttccagtgagtgatcgggaacaggcatgtgtgtaatactgtaatgccaacgacggcataattcttgaaaagttcatttgcagaaaattctctgacttgatgaggcaaagtttggccccctgaatcattctgccacggtgtgcggcatctgcagagttgctctcaagtttacaatcctcgcacttttgaacttgcttcagctgcagtccattaaaaactgaaagcgccattccctggtacccaagctggggtttactgttcgggaagtcatgggaaagtggttttatggcgggactcg

SEQ ID NO: 105982 - DNA, 390 bp, Homo sapiens
caaattttcatggccttgcattaggaaatggattctttgatatggtaccaaaagaacaaaaaagaaatgaaaaattgatatattggacttaatcaaaattaaaaacttgtactatcaagaaagtgaaaagatgtccgggcatggtggctcacgcctgtaatcccaacactttgggaggccgaggcgggtgaactgcctgagctccagagttcaagaccagtctggccaacatggtgaaaccctgtctccactaaaaaaaaaaaatacaaaaaattacccaaacatggtggtacatgcctataatcctagctacttgggtggctaaggcaggagaatcgcttgaaccctggaggcggaagttgcagtgagcggaaatcgcaccactgcact

SEQ ID NO: 105983 - DNA, 382 bp, Homo sapiens
tcctcttcttctggcttaggtgtgtaaacttgagactagatatgaaacagtaatattacaatcatgaaacgacaagcacgataatgacattttaaaggtactgcattagaaatgaactgcatacttccaagacttattgttaagagaacaaaagacagcccacactagttaaggcactaaagttagactactgcaaccttgtagcagaacataattctaatatgatactgtcattacccatcactacacttcaaaaataaaaccttttgccattctaaggtggaatatcttcagttacacacacacaccccctttcaaatcaactttctttaaccataacacatttaatgttgacctcatttaaactatttttgcataaaat

SEQ ID NO: 105984 - DNA, 372 bp, Homo sapiens
gcattaaggggagacctgtcctaagtatttctgtgtgctttccagttaaaggtgttcctaaaccttaaatgcttcttgaaagagaaatagctgccttgagtttagcaccactgcttccatctgttttgagtactagctacctttctagtgtctacataattttgcaggtttcctgttctacagttgttgcccttttaggcactccggtgatgtggtttaaagtaggtgcttcacagtcagaaagatacagttttttccaccctgagcatctccacaatgtccgtgggcaaatagtttaaaccgtctgttccctaccttctacagctgtaaaattgcggtaataagagtatttttctcattgatttatcatgc

SEQ ID NO: 105985 - DNA, 362 bp, Homo sapiens
agattgggtctcatcatgtgtccagactggtctcaaactgctgggctcaagtgattctcccaccttagcctcccaaagtgctgggattacaggtgtgagtcaccatgcctcgccagtccccaggtttaaaaaaaattctccctttgaagttgtaggaaacttagaatgtgtatgaaacaggattttctatcacattaatttaaagtctctctttagagtatgttacccaacgtattttcctttcctgtatttgagtgttacagtataatcattagtgttttcagtatgttttgtctaattatcctatttgtagttttttttctcgtgaaaaacatcctgagtagtactttttgaacattctg

SEQ ID NO: 105986 - DNA, 363 bp, Homo sapiens
ctataccctataacctaggtgtgtacagcctaggatataccatcaaagtttgcgtaagtacgctctatgatattcctcaggaacaaaattacctaccaatgaatttctcagaagatgtctcagtcactaagtgatgtatgactatgtatgactacatagattagaaaactaaggtctcatgttaaaagatggtattcaatcccaacctgactgtgctcatccactactctagttctaacctgtgaagaacttgggacatttcaggaagagagatactttagatggatttaaaagacaagtaaacaaagaagagctagaatagtgaccaggtgagcaaaaaagagtttaaataatatgactcat

SEQ ID NO: 105987 - DNA, 322 bp, Homo sapiens
cccttactcctggagcggggggagactaacccctctcctgtgtccacaactgtagtaacacaatcctcggttctgctctccaaacttcaaataaggggtcagagccaagggtcaagactttaggaaaagccccggaaataccctgcactcaaaaagcagtttcagagtttcacattttcctgagaattaaacaaattatcctccaaattctgctgcttgttttgaattatggttatactggcaatgttatccaacccttgagttgtttttcttttctttttttttttttcctcgagagagtgtcttgctctgtcacccaggc

SEQ ID NO: 105988 - DNA, 420 bp, Homo sapiens
attcaatgctaaaggggccaatctgccaggaatttaactacctgcatgaacaaaactcaatgctctttaatccagactccctatagtatatcgatcataatgttcaacatagtaaaacaattactagatacacaaggaaacaataaaatgtgacctgtaatcaaaggagggaaatggcaacagaaatagaccctgaaatgatccagattttggaattagtaaacaacaactatgaagcacctattataatatgtcaaggagttaaagaaaaatatggttataacaagtagatgtgagtttaggagcgagataggtaatatcaaaaagaaccaaatagaacttctcaaactgaaaaggtaatacctgaaatgaaaaataaattagatatcattaatagcagatactttccattgatttatt

SEQ ID NO: 105989 - DNA, 671 bp, Homo sapiens
aatagcaataaaaaggttaagaacaataaaaaataaaaattttaatgaacatactaaatgtgtaggaaggatcagcattaagttcatatagcataacctattatatctttgattagacaatttacaaaaggaatccagtgaccaaaaatgagagggaaaaaatgcagtgtttcaaatggcttatctaagagtgtatttaggtacctgctttgtaaaggttttatgtggattgaaaagttaatgtgtttatatagtagttatgtatgtaattatgtatatagagcatttttcatatattattaatgggtattatatgatactatacagaaactaaagcgaaaaccagaaatttatataggacgtatagatggaataaagtctaacagttttcctaacctattgatactgcttatacatgtaagcaagtaaatattttagaatttatttccatgctatgaatagaatgctggttagtgcatttcaaagtggctcaagaaaattcctctgagcttatcaagaactgaaatgcaaatgtatgtaattcccagtacaaatggaggtgtacaccccaaactgccagtcagaactcatgcagctgagtcaaaaggccatgaggtagctgtgtagtctttgaattaagataaaacctgttacacctaactccataatct

SEQ ID NO: 105990 - DNA, 394 bp, Homo sapiens
gtttcaccctgttggccaggctggtctcaaactcctgacctcaggtgatctgcctgcctcggcctcccagagtgctgggattacggtcatgagccatggcgcatggcctatacagtattcttattggcttaggtcttttaactgggttattactgcttcataattggtctccctgcttccagtttcttccatccatatcttccaacctgaccccaaaagtaattctttcctctttaaaaaaaaaaaaattataaatacattattttagtccaggggcagtggtttacacctgtaatcccagcactttgggaggccaaggcggctggatcacttgaggtcaagagttcaagaccagcctggccaacatggtgaaaccccgtctctactaaaaata

SEQ ID NO: 105991 - DNA, 406 bp, Homo sapiens
tttccagctgagggcttggccccagagtttcctccactggggcagggtcttcttgtctcctgctgcgctttcccttccagttgtactcatgcccccctactcattcttatctccatctctagtcccctccccatcatccccctcacccgtacccccctccttctgtccttggattatcagtgaagtgaggggggttgggctccagagcttgctgctgtgacctagatttcaaggcagagacagttcctggtgctgacagtcagagagcattgttcctggcccggcctggcagggccactgctgggcccttctgtctggttgcacctgggtgtgcaactgagcatgcctatgactgcctgtttcttgcgggggtcatggtagccctcctgtctggctcattgtctgc

SEQ ID NO: 105992 - DNA, 615 bp, Homo sapiens
ttcatgccattctcctgcctcagcctcccgagtaggtgggactacaggtgcccgccaccgcgcctagctaactttttgtatttttagtagagatggggtttcaccatgttagccaggatggtctcgatctcctgacttcgtgatctgcctgccttggcctcccaaagtgctgggattacaggcatgagccactgcacccggcctagaacttcattcttaaagccttttacgtgaaccagaaatataatgaacttgagaaatagttaaactagcaggcagtgattaggttttatgatatcattttaattttactccttacagttagtaggaagactgaattgaggagaattttctccctcctttacatggtcctttgccctatagctaaatgagagtctgattagcaggctaactaaataatatattaacctttttggatcttcatccaagaagtttacaaagcatgactaaaatgaagtcttttgtgcaggtttgaagaaccctaatatttatgacttttagacaagaaaatcactaggatatcacactgtttcttcttttaagtacatgaacttaatagtctattctctgtatttaacatctagtcttaggaaa

SEQ ID NO: 105993 - DNA, 637 bp, Homo sapiens
ggaacatgaagtgggtgaggtatacagacttctgatggtccatcctgagccacaggaagaatggatacaatttaaaggagtggatatactgctcatccttcaaactattgtgactgggctttggtaaaagctcagcaagaaatgaagagtagacagagtctcacacctgtaatcccagcagtttgggaggccgaggcaggcagatcacctgaggtcaggagtttgagaccagcctggccaacatggtgaaaccccgtctctactaaaaatacataattaactgggcgtggtggctcatgcctgtaacctcagctacttgggaggctgaggcaggagaaccacttgaacccaggaggcggaggttatggtgagatgagatcgcgccattgcactccggcctgggcaacaagagtgaaactctgtctccaaaaaaaaaaaaaagagtagacagagtgaggtagaagtctctggagagaacccaaaggttatatactctgtactactggctgaggatggacctacaaaaattgaatatcatccaagcacagtattgctgaggtcctttcatgaaaatttgaggcctcgttaaaggctgtcccacatcagcatagatgagggccccattaataaaaggcca

SEQ ID NO: 105994 - DNA, 199 bp, Homo sapiens
atcggttgagtggggatgctgctagtgtgtctgcacaggtttcttgaggggacttgatgcttcccacaaatgacagtagggatgtggccaccgtaaagtggtgctgtgcttcgcagcactgcgtgatctgacccacgcttacgtttcaaagccattgaaacagattcaagatcatgtattgatttaaaaaatttactct

SEQ ID NO: 105995 - DNA, 367 bp, Homo sapiens
cagagcaagactccatctcgagggaaaaaaaaaaaaaggctcttcagcgcttctgttggcctgtgtgtagtttggccactgtctgggaataccttgtaccaattgctgtctgttaaaaggatgaaagatacaatgttcggagacagaccctgggtgacaatgctcttagtcttttccatatctaggaggctgccgtaagtttgataattgaaagattccaacctgaaacagctcagtgtttttccccaagcacaagaacattaagtcctgaccttgtgcctttctatgactcaacacagagagagccttgcgtcctttcttttggttgtcgtgctgagtctatgatcttttcgaggtcatagcagta

SEQ ID NO: 105996 - DNA, 362 bp, Homo sapiens
agaacatcctctcaagtttcctcaggttgtcagctgagttcagttccttgtgactgtaggactgagatctctgttttcttgctggctgtcagccaggggcctctcgctgctcctagaggcctcccatgttcccactgcatgcttcctccagccagcagaggaggatcgccctgcatggaaaccctcctgcacttcacatctctccaggaagtcctcagtccctccaaggaactcaccttcactaggtcaagctcatcagataatctgtctatcttaaatttgaccgatttgggatctcgattacatctgttaacttgtttttgccataaattgtaacacaatcgcaggagtgacatctcctc

SEQ ID NO: 105997 - DNA, 420 bp, Homo sapiens
tcaagttctgatggccagaagcatcatgtggccccacctcgaggagggggccaagaggaagaaggatgcagagtggggcagtacagtcacctctgtcacagtccctgattatgttgtttattgtccgagccccgactccggatggaaagtgagccccatgaaggcagggacatctgtctgttttgttcgctgagatatcccagcacctagacgtaggcccggctcatgggacgagcttcatcaatatttgctggatgactgagtgacaggtgggacacccctcgtccctgctgctctctcctctcctgtctcaaagacttcatttgcacatggcagtgttccacataaaatgccagcagacagtgtgcctgaggcctgaactcttccctgtaaggaattctgcctctatgctacagctca

SEQ ID NO: 105998 - DNA, 151 bp, Homo sapiens
attttatccaattctttagtctcttaagatgtttagaccgctcacatttaatgggatagttggatttaaatctaccattttgttctttctttgcattctctttgtcccacctcttttattcttctttccttatctttttggttacttattt

SEQ ID NO: 105999 - DNA, 104 bp, Homo sapiens
atgggagctggttaggggaggtgggatagaggaagagagcagttagtttggttttcctctttagccagcccattgtgggctcctcttagcaatttatgggcagt

SEQ ID NO: 106000 - DNA, 288 bp, Homo sapiens
tgtgcctggccccactgcagtaaatttgcacattcttcaccctctcagaggtggctgtgtgaatgtctgcagtcctgtctctagtagcctgtctttaaagccctgataagtgtgcacacacacatgcatgcacacagatactgtttttgctatttttcttgaattacagggatagtgtctctgcttgctttgagcactcacttctggaatctccctgggtctgggaggggcagtctgtaagtgtgatttaggaaaagacccatctcttccctccttttttttccttca

SEQ ID NO: 106001 - DNA, 704 bp, Homo sapiens
attggcttggtctgaattgggtgtgtatgtacccagtgaatttaactttgtatctctttatattgtccttctgagaatcatttaggatctttacgaggttaaacagcaaaaaagctgcctaaatttaatgtggtaagctgagccttctatatgctaccttcccttcaaacaattgtgaaagacttttcttcttaaaaatgaacttgttcctttgttaaaataaaatgagaccaggtgtggtggctcacacctgtaatcccagcactttgggaggctgagccagaaggatctctggaggccaggagtttgaggccagcccgggcaacatagtgagaccctgtttctacaaaagaaaataagaaaattcactaagatgatggcatgtgcctgtagttctagctacttgacaggctgaggtgggaggatcactggtgcccaggagttagaggctacattgagctgtgatccccccactgtactccagcctgggtgacagggcgagactgtctctaaaaaaataaaaataatgataataaaatgaaacatatgattgcatttaaaaatagcatgaagttcaaaaccatcaaaaaatagtgatagcaaggacatgaggaggcacctggggtgctcgctgttttctattattcatctgtggaatggtcacatgggtatatatatttagtgaaaattttatcttgctatat

SEQ ID NO: 106002 - DNA, 634 bp, Homo sapiens
taacaaaaatttgttgagcacattttatatttgtcaaatttcttaattgtaaactggaaaatctgctctagctattttaagaagcatggtttattaaacataaagaatctcaagaaaagtcagaaaactgggtttggctgctacacagagcaaccaggagacacacctaaccacaccactaaactgctctgcaaagtactactgtatagccacatggcactggattccagaaacttccctgcaactgcctcagaagaaccagatgcctctgccaccatgccccccgcagatctgatgttcctccttatggctaccacctctcactgctcacctccaaaccccacatagggctgtctgcttggtggagctacatcttaagcaaaacatgaccttcaagacaactaggaaaagtaatttcataggaagtcaaactagaatgagggctgccacgagaactgagggagacagctttgtttctgccatgttagcaagtgctgagcactgttctccgcagtgggggtcgagctatgaagaagagagacaacgtctctggccttgcagagcagaaagcctagaggggaagcagataacaaataagtacctaaatataattttaaatagtgataagtagtat

SEQ ID NO: 106003 - DNA, 176 bp, Homo sapiens
gtccattattgggcgaaggtcactgcagactcagggaggcccaggagctcaccccaaccagcttctttaccaggtgagtgacctcagccctgcagctggactcatggagacaatgacctcacccgaagatagatgacccctgtccaccgtccacacaacaactgaactggccccag

SEQ ID NO: 106004 - DNA, 420 bp, Homo sapiens
tttttttttttgaggagtctcactctgtccctcaggctggagtgcagtggcatgatctggactcactgcagcctccgcctcccaggttcaagtgactctcctgcctcaggttcctgagtagctggaattacaggcgtgcaccaccacacccagctaatttttgtatttttagtagaggcagtgtctcatcatgttggccaggctggtcatgacctcaaatgatccgcccacctcggcctcccaaagtgctgagattacaggcgtgagccactgcgcctggccatgttaagcatttcttaatgtgctgaaataatcactgcctgcttcaaaacgtagctcaaaaaaaatccacatttttcttcagatcctcaaaaaaaagctttaaccctttctatctacttttttaactgttcagattac

SEQ ID NO: 106005 - DNA, 345 bp, Homo sapiens
aagtgagtatgatgagtcttctaagccaggcagatagcaaaaaaattaggaaagtaaatggattgcacaggaagaattaactgggatttaaataatcaaagacagaaaggatatataaaagaagtgacgaaggagatttaccctattagactccagtgtattaatctaggacagtttggttgctatggggaagcagtgtgcaaaaacttaagaggcacacaaaagactgatgtttattttgtgggagtgaatctttttttaggaaggaaatagcactattgtggtaacagtgattcattttctcctcctatcttctctttacagagaagacccaaatagtgaact

SEQ ID NO: 106006 - DNA, 152 bp, Homo sapiens
ccgaaatgttatgcctcgaagagaacttccaagacaacactaaccaactaatgtaacggtgcagtaacggtgagctctacgtaatgtttatcaccctttcggtaaatagtggtcccacggctcggcctgcttttggaatgaagctacgcttg

SEQ ID NO: 106007 - DNA, 504 bp, Homo sapiens
ggagtagcctatttaaatatataactcatagattaaaaagtttgtgttatctaggaccatttacttcctttgtaccaaacactgtaataagcattatgtatgtacttccttatttactacttacaaacttaagaagtcgctacctaatactccattttacacatgaccaaactgagactcagaaagataacaagtccaaaatcacagagttcttaagtagccgtgctggattcaaatccaaaatagtctgactcaagaactgccagataagaagtgttaacaggtgctgggaatggagcccctggttgttactctgtattttccaatacgaggacatcatagatccagtaacacgccagcagcaaacaggtgaaataaacttctcccaggatatctggatcttttaaaaagcagacacttaaaaattttacttctattctattgcagaacctactcatctgtaatccactgacccaagttgcgacctgatagaacacaactatc

SEQ ID NO: 106008 - DNA, 96 bp, Homo sapiens
ttatctacactccaccatggccctcttttaatctagttaaagcaactgcttctcccacgttgattaaatccttgaatctagaaatgtggttaaggc

SEQ ID NO: 106009 - DNA, 230 bp, Homo sapiens
tgcaggcactagtgaccttgacaggccattggtgactttgttacatggtgggggtaaaagtctgattgaaatgggttgagaagagcccgaatgttcttctgattccaaagtcaatgcctaccttgttttgctaagctgcatagaaagttctcgtgtgcaggatgcagtcactgaaaatgttgtagaactgaagaatttgtacctcattcttggaaccactcaacctggaa

SEQ ID NO: 106010 - DNA, 351 bp, Homo sapiens
gcggccgcctactactactaaattcgcggccgcgtcgacttgcactccagcctgggtgacagagtgagactgtctcaagaaaacaaaacaaaaaaccccaaaactcttctcctccagcttcatcaccatccttggatatttcatttctctgcccactgcctgcctctgcatccctcaggctgttaagttacatgagctgatacagccgctttgtggcttaagtgacactgagctgtgtttctgtcacttataaccccaaaagtctacaggtggagttgctgatgcggacacccccacagctccatctcccatgcaagaatccttgctgtccccactgtaccctgatgctcc

SEQ ID NO: 106011 - DNA, 793 bp, Homo sapiens
aaggactgagcactgggagactccaatggggagaaggggaggaacaagcaaaaagatggagaaaaagctaccaccagtgacctaggagaaccaggggctggcatcctgcagccacatgcacatggaagatcactttgattgccatgtggagagtgaactgtgggaggaccccagtggaggcaggaagactaaaccagaagacagtcacagtagtccagataagagatgcatatgttatcaatcgccatgtgaagaagatgcttgcttcccctttgccttctgccatgattgtgagtttcgcgaggcctccacagccatgcttcctgtactgcagaactgtcttcgattagatattacttcttctgaacaatcttccttgatgacccagctactttacatctctggatggaatcctcctctttgctctaatgagtctgtggctgtgtgttgaaatagcagagccttgagatgagatccttggattactgtatggaagagagccacctagtaaagacactcaactcacattgaagttggtatgagtgagaaaatctctgttgtgagacttaaaataggagaaaaaaacctcacaaaacgacaaaaaagagagaaaagacaaagaagactgttgtaaaaataagaagctttgaagaatctgaagcagatgttatgctgggagctagtattctattactgaacctgtggagacagattgaattatctaatggataatttgaacttcctattcaaaaacaaattgcctgaaaaaggatacattcttcagagtatgcca

SEQ ID NO: 106012 - DNA, 1862 bp, Homo sapiens
tcccagagggtccccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaagaggtgaatctggcagctgcggtgatagcagtgctgggcctggcagtcatggccttggggtgcctctgtatcatcatggtgctcagtaaaggtgcagagttcctgctccgagttggagccgtctgctttggcctctcaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaattta

SEQ ID NO: 106013 - DNA, 838 bp, Homo sapiens
caggacctaggagaccaggttcctctcctctcagatccaagattctggaagcaaactgcacctattttaaattcttcaccacgggggagaatgcacgcatctttcagagaaccacaaagaaaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaattta

SEQ ID NO: 106014 - DNA, 1527 bp, Homo sapiens
caggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgtaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgtttttttctttaaaaactacaacccaataatgatgagtgaggctgttgtaatttttggaaacatgataatgggttgttgcaaatatattgaaagttaggggctgtgtgcagtggctcacacctgtaattccagccttttgggagtccaggtcaggtggattgcttcagctcaggagttcaaggtcagcctgaccaatatggtgaaatcctgtttctactaaaactacaaaaactaggtgggcatggtggcacaggtgagaggatcacttgagcctgggaggtcaaggctgcaaggagccaagattgtaccactgtactccagcctgggtgacagagcaatatcttgtctcaaaaaaaaa

SEQ ID NO: 106015 - DNA, 1249 bp, Homo sapiens
  misc_feature (1249)..(1249): n is a, c, g, or t
caggtattgtttttgagcattaagattctaatagtgtgaggagaataatgtttgtgtttgtgtgttctcccttgttaagtctcttgaaatggagaaatcaaccgttttcagcttctatttagctttgagcttcaacatcctcaccaaacatatttacatttagaagaatatccataatgctttaagcaattttgtcttaatattagacttagtatggaaataagcctttttgggagcaaataaaaagtttttcaaggacaatttgttgtaaaaagtaataaagattccatcactctagcaggtccaatgtaccccgtataagtggattacagcagcgtaggattttgtaattccattttaacttggtgcccagttcttctctaaggaattcgcttattccctacattaagcaataagtaaaatatcatgaagatatgaaacttaatttgacttctaccaactaagtgcagagggtgacggaaaaaaaaaaaaaagacagtcatagcatggtgtaaaggaggactagtctaagggtcatggatgaggatttttgtcatgaattcactactgtttgcctaggctgtccttgggccagccacctggtttctcagagcctcagtgtgatccactggaaaatgtgatcatgttcaatgtcctttcctaatctgtcattctgtgaagtggtgcttccaggtcaaggaaacaaataggtcagaatgttcctgtggtcattgttctctttaggctcattttccatgaaatagttgtattcctcttcctgtagcacactcaggttaagttggagctctttaacctgggcattcttcccaatacttcattagaaataccgcctgcttcaaaatcacctttgtttgcactatctactacagcgtaatagacttctggctcagagagtgaaagctgtggaagaaaactagaagaatatttatgttaactcccttattttacagctaatgaagttgaccctagggaggtttgatgactctccacccagtcccaaagctcctaaagcaaggaatcgagttcctaatgtaggatttttaattctcttattggtgtattttccacttgtctatctttaccaaaggagcatcagtgatttttagtggatttcacaaaggagtaataggacagcttccttgtcctgttttttcttcctacacccaatatgttaagcagctgctgcttttggaccagccacgtgctggcccactatttcgggtcggcn

SEQ ID NO: 106016 - DNA, 503 bp, Homo sapiens
aaaggcccgcgtcgacccctagatgacaatcactacagccaggagcactctgtgggtccttgcatcctcagccagtgaagtgtgttcttggggtcctttttggaacttagaatacaatttcaccatataaaaatatgtagtagataaaaagcattaatcaatacggtatttcatgtattttaaggattaaattaggcatccttcaccaaactttgatgcactaatcactattatctattttgagatattgattcagagttacaaagatcaatgtacaaataaaattttgacagaaaaactgcttgtcaattgagctatatccgtagtttcctaaaatatattttttcacactttgcttatgacatcctacttaaacccaagcacactatttctgcttcaaagaagactaactctctcagtgatttggcaaggctttatagtgttctaagccagcttgcaaagcctcaaacaagtatacatatctatgcttaggcagctttaac

SEQ ID NO: 106017 - DNA, 546 bp, Homo sapiens
gcacgcgaacgtgttatccctaggacttgtttgaatacattgctgtatttatctaaaagggcaaagctttcattaaaaataatctagtggcaatgttgcacagccctaattctctactacatgaaaagttatattttcaggcccagagacacaggattacaggtcagtgataggcaatgcatatttgaagtataccaaaagcaccaaataatgtagctgagtatccagaaggaactgacataaaatgcaggggtctaattactagagtcattgccacagaaccagtcatcgatgactaaattatgcacctggtttcctgggaaaatctgcagtttggggaacatttcactacacttcagagcattttaagtctttaaatcatttagcttttaaaatcccacccatttctcctgttccggcatccattctaaatatgtctctagttcctgtcagttcatactcttcaatacttgatttcacttttgtgatccactcttctctgtggtttctgaagagtggatacactcgcgagccttgaccatgcca

SEQ ID NO: 106018 - DNA, 321 bp, Homo sapiens
ttagtctcgcccctaaccctgcttctagtggtcacagcagctacagggaccatccagctgaaggtcttggtatgtgatctcgaaagtcaaggtcagcgtggagaactggaaagaggcctgactagaagacagactgtcgctggtcagttgtgtcatcttctgcaagttgcttaaacctgttaagttttctcactctaaagtgaggtgttggggcagtgtctctgactttgaatgtgcatgaatgacctggggaccttgttcaaatgcagattctcatccagtggtctgggctggggcctgagattttgcattgctagcaag

SEQ ID NO: 106019 - DNA, 635 bp, Homo sapiens
ttcaagcaggtggccgagatgctgtcggcctccaggtaccccaccatcagcatggtgaagccgctgctgcacatgctcctgaacaccacgctcaacatcaaggagaccgactccaaggagctcagcatggccaaggaggtcatcgccaaggagctttccaagacctaccaggagacgcccgagatcgacatgtttctcaacgtggccaccttcctggacccccgctacaagaggctgcccttcctctccgccttcgagcggcagcaggtggagaatcgcgtggtggaagaggccaagggcctgctggacaaggtcaaagacggcggctaccggccggctgaggacaagatcttcccggtgcccgaggagcctcccgtcaagaagctcatgcggacatccacgccgccgcccgccagcgtcatcaacaacatgctggccgagatcttctgccagacaggcggcgtggaggaccaggaagagtggcatgcccaggtggtggaggagctgagcaacttcaagtcccagaaggtgcttggcctcaacgaagaccccctcaagtggtggtcagaccgcctggccctcttccccctgctgcccaaggtgctgcagaagtactggtgcgtgacggccacgcg

SEQ ID NO: 106020 - DNA, 362 bp, Homo sapiens
ttgtaatgcaaccaattagatataatgtgtttatacagaagtgatcttcaagggaagctgccttatttgtgcaagtcagacattgtagaggaggtatagttagataaataaaacatataggcctgtgaattttctttattcatttttaacttttttattatagaacatttaatcacatgcacaagtagaaagaacaggccgggcatggtggctcatgcctgtaattccagcactttgggaggctgaggtgggcagatcacaagatccggagtaagagaccagcctagccaatacggtgaaactccgtctctactaaaatacaaaaatttttcaggcatggtggcgggtgcctgtagtcccag

SEQ ID NO: 106021 - DNA, 431 bp, Homo sapiens
cggtggcggctcccggccgggcctcggcgcctccgccgcccccgcccgtgtactgtgtgtgccggcagccgtacgacgtgaaccgcttcatgatcgagtgcgatatctgcaaggactggttccacggcagctgtgttggagtagaagaacatcatgctgttgacattgacctgtatcactgtcccaactgtgcagttttacatggttcctccttgatgaaaaaaaggaggaactggcacagacatgactacacagaaattgatgatggttccaaaccagtgcaagctggaactagaactttcattaaggaattacgctctcgagtcttcccaagtgccgatgaaataattataaagatgcatggcagccagctgacacaaagatatctggagaaacatggatttgatgtccctattatggtcccaaaatta

SEQ ID NO: 106022 - DNA, 306 bp, Homo sapiens
cttgatgtattagggtttagagaatagctgcaaaaagttattttctgtatctgctggaaaacagcatatctttgtaagtacagattgtaaggcagacagattgtaattatgtggatagagtagcgagtggtaacagagcttgacagaccagtgttcacgtgacagagtgtgcagccctcaagcgcaggtgcaggtggctaacagtacagggttaaggggccaaagtgcacagacaaggtgttggccagggcctctccacattttgcaaacttctcttcccttaaaaaggaaggaaaaaaaaaaaga

SEQ ID NO: 106023 - DNA, 112 bp, Homo sapiens
aagcaatcttcccatctcagcctcccagagtaatgggattacacgcataagccaccacacctatccaataaaattatttttttaaaaactgttatggttggaaaatgcagct

SEQ ID NO: 106024 - DNA, 312 bp, Homo sapiens
tttttggagagagtctcactctgttgctcaggttggcgtgcagtggtttaatcaaggctcactgtgctctctaactcctgggctcaaacaatcctcccgcctccgcctcctaagtagctgggactacaggcttgtgctatcatgcctggctcatttttcaacctttttgtaagagatggagttttgctatgttgtctagggtggtcttgaactcctgggctcaaacaatcctcccgcctcagcctcccaagtagctgggactataggcttgtgccatcatgcctggctcatttttcaactttttttgtagag

SEQ ID NO: 106025 - DNA, 1009 bp, Homo sapiens
ctagaagagaccctagggttttgatcagatgccctcattttttaaaacagctttgttaagatgcaattcatatgccatacaatgtacctgtttaaagtgtgtaattcagtggcttttcatatattcacaaagttgtgtgatcatcaccacgaccagttttagaacattttcatgaccccaaaagaaacctggaccccttagccaataccctccattcacactccattccccacctcccattctgcagcaaccatgatctactttctgtctctatacattttgcctattatggacatttcacataaatggaatataatatgtggcctttctatctggcttcttttttggagcaaaatgttttcaagggtcatccatattgtagcatgtatcagtgctttgttcatttttatgactgaataagattccatcgtatggatatcccacattgtgtttatccattcatcagttgatggacatttgggtgtttccagttcttgactgttacaaataatgctgctgtggacattcatgtacaaatttttgatgaatgtatgttttcatttctgctttcattttaagaaaatgagctgaagctcagctacttcaaatactttagggaacatagtggagtataaagaaagagaggagggaattgagcctcccaaggtgttaaatgacttgccaaagtggaagatctttaacatcctctgtctgtgtatgtgtgtgtttcagtaggaagatgatttaaaagtatttaaaccccaatcttatttagaatatgaatgcaaaggattatcatttgtgagtttaatactaagtgttttcactaactctgccctgggttcctgggttttagttagaaatttctgaatgtataaattaatacttatctgtaaaaattcaggtgtcaattgaatcatacaatgaatgcaagatatttgttgaattaaatgattagcatttatattaaaggtaagctagactctaataaagtttttctattaatatt

SEQ ID NO: 106026 - DNA, 314 bp, Homo sapiens
aaaagaagtttctgtcagaatctgtttgagtgaacagtttaaatttttttaattaaaataagaaggctgaactcccaagtcctaatttctggagctgttacattttggtcagtgttttctagagtattctctgcattcaaaaattgccatgtaacttaacataaacagaacatgtgaatgtgtcttataacttgtttatttcagatagcagtaaattattgagcatttcatctcagagtgttgatacgttatccttttcagtggcttcatagtattcctttgttaggctataccatgatttatttaacccaatc

SEQ ID NO: 106027 - DNA, 397 bp, Homo sapiens
ttcctctagggtgattctccaaactcttctgctctcccctggagctgcagaaaatccttcagcctacttaagtgccctactgtatatgggttctgtggagcagtcataaagaacgggaaagaaagtcaaagaagggagttgcataagaaatggatgtaggacaaatacaaatcttttaggctgggtgtgtgtgtgtgtgtgtgtgtgtgtgtgtgtgcacgtgcacgtgcatgtttgtgtatgagattttttccccatagaaaatataagcaattcagtcataagaaattctatctccaaggctgcagtaaactatcacacctgtaggcttttatttttcacagaggaccctgtaaaatccaaggcagcaaatcagaattctgtgtggtttagaggg

SEQ ID NO: 106028 - DNA, 648 bp, Homo sapiens
caggacacactgccttatctttctgtcattccatgatgttagactttctgcccaacaagtttccaaaaccagagttccttagcttttggtacctcatgaggggggcttttaaagccttggataaatataggaaacagatttctgttcagagccagggataacctcttttcaactaataagtcctatgaaatgaaatccattcttctgatcctaaatcccatctaaagtaattttcataaaattgagggcatatttgagtacagtgcatcttacttgaatgagggaaaaaatatggtttctaagggaaaggggaaaaaatcttgtaatcaaatgtgaagaaaacactccttggcctcccaaaccaggtagggtctcgttctaaaaggccccaaagcaaacgaactgtgtgtcaacagaatgaccattgtgtggctcccttttgctgctctagtcactgatgcaactacaaaccagagagcatacagatgctcctccagcattgccacgagcaccagtggacatgtgagccttagagaaatcccaagaccctgagtgtcacagtgagctgagaggtgcactactagaaagccaatggggtgggagggataactgtagacacatcatggccacctcagggcttctggagaa

SEQ ID NO: 106029 - DNA, 1802 bp, Homo sapiens
  misc_feature (799)..(799): n is a, c, g, or t
gggtagggactgtcaggcagggctatgagatagaggccctgagagtatgggatttttttgtgctgatcgggagaaacgtggagaggtggtgtgataggaggagctgggtcaccccattttattatatgtcatgaaactggcttccttctgcatgacctctaaagtaactactcccagtgctgagtagaaggacactgtaaataggacaaagaaagtcttgatgtggtgtcggaggctaatgaggacagaagaaaaagaggaaacattcacaattagtaaaagacttctggcttatcattgcaagagaaatgtttgggggccaggcacagtggctcacacctgtaatcccagcactttgggggtccaggcaggcagatcacttgagcccaggagttcaagaccagcctggacaatatggggaaaccccatgtctataaaaaatacaaaaattctcctggcatgttagcacacatctgtagtcctagctactaaggaggcttaggtaggaggatcacttgagccccagaggtcgaggcagcagtgagccatgattgcaccactgcaccccagcctgggcgatagagcaagaccctgtctatttaaaaacaaaaaaagaaaaaaaaaagtttaggttctcagccatcccctgagctttaggctcaggaactctctgatttcaggtaccaagaaagagaaaatgggctgggcacagtggcccaagcctgtaatcccagtactttgggaggccaaggtgggtgaatcacctgaggtcaggagtttgtgaccagcctggccaacntggtgaaaccccatctctactaaaaatacaaaaattgctgggtgtggtggcaggcacctgtaatcccagctactcaggaggctgaggcaggagaattgcttgaacccaggaggcagaggttgcagtgatccgagatcatgccactggactccatctggcctggatgacagagtgagactctgtctcaattcaaaagaaagagagagaaaaaataacaacaatcttataattcctgtgactaaaattagggggtgttcctgcattacaccatgccacctctggagcaactttctctgtcactcacaaagctttttcatatgcctgccctttccccctacttaggctccccctttagaactaaacagctctggaaaggatccttcagagcagacctagggcaggagctaggcaagacccttgatggtgacaacttatttggctatttctcgtggctatttaatacatgaatgggagctgagttccctgcttaatagcatttgtgttcatttccagcgtggtgccggttgtctgacctctagcttctcccctcttattctgtacagctgaaattctccctcctgcctaccccccagctagtcagcctccagtcctgtttagtttatcttttttctctcctaatgcctgttaagctggaaacaggattcttgctcgtcgtcatattattttaaataagaatgaaactaaagaagaggtctttgggccaggcatggtagctcacacctgtaatcccagcactttgggaggccgaggctggcagatacctgaggtcgggagttcgagaccagcctgaccaacatggagaaaccctgtctctactaaaaatacaaaattagccaggcgtggcggcgcatgcctgtaatcccagctactcgggaagcctcaggcaggagaatcgcttgaacctaggagacggaggttgcagtgagccaggatctcaccatagcactccagcctgccaacaagagcgaaactccatctcaaa

SEQ ID NO: 106030 - DNA, 498 bp, Homo sapiens
agccaccatgccagccccagggaaggttttctaggtgggaagtgacatggtaaaattagtctgaaggtggtgtctaagatgatagaaagggacttgggaggaagctaagttgtacaggtgaaacaaaacacggatctaaaatataggggtgacataaatccaggaaactaaagtaaaaagtcaacattgtgattctcagaagagaaaaacaaattaaaactaaaacattcaaaattttacctataactttggcaaacagatatgagaaaacaagcactcttatatttcactggtaggaatggatttggtaatgagcaatgtgaaggactaattatcagtatttatagaaaattcaaatgtacaccctctttcacccatctgtaaagttattctacagatattttcacacatctgcatgaagctgcttagacagcgatattcattattaagctgtttataaaggtaaaagattgagaataacgtaatgcttgacaatag

SEQ ID NO: 106031 - DNA, 352 bp, Homo sapiens
gtcaatggaaagaagctctacaaaaagggacactggcaagttcctccaactactagatttagaagaatgttaaaaaatatatatttaaaaattatggatgcatttaccctttcacccaaaagtttcactcctaagaatttatcctaaataaatggttgcataaatacaaaatgatgtttgcacgtcatggcattatttgtaatagcaaaggactggaaacaacccaaatgccccgctttaggggtctggttgaataactagggtgcatccacacagtgaagttctatagagtccatagctttgtgagccttgcaccacattcccccaaactccagcgaatctgtcggggaca

SEQ ID NO: 106032 - DNA, 2184 bp, Homo sapiens
  misc_feature (786)..(786): n is a, c, g, or t
  misc_feature (1101)..(1101): n is a, c, g, or t
  misc_feature (1154)..(1154): n is a, c, g, or t
  misc_feature (1443)..(1443): n is a, c, g, or t
  misc_feature (1608)..(1608): n is a, c, g, or t
ctggaaggagtcctttgactctcctccctgccttttgccattattttgttaattaatgtttttattagtgtctgtaagacctaatgaagctgaggaaggaaacatgatatggcttcctgaattttgtggttttgcagcagtaaggttatgtgagggcttccaccctaaaggacacccttaagcacagcacttaccaatttcctaagaaaaacatcttaagcaattcttaaaagacctgggaagcaggcatatttgctgaacgagtgtcccagtcattttaaagccagtctcatatggcatgcacatcagttgctttgtctgggatgttccacttggcatttatagagggagttgggtagtcccccttctcaggggagccttttatctagtccaccagcctggctgtttgctcaggaataaccacctttgtctggatcatgtatagccatgtgattgttccattgtgagccatgcattctgcatccaccaaaactttttcttcattttgcagcattatacagaagcttatgcatgcagccgtcataggtttattgcctcatgtccacagcaagtcaatatgcacagacactgggttgcagtagagaaagaggtttatttgtagggccactagatgacgagacatgaggaaacctcaaatctgactccctaagggatttgtggggttagggcgtttaaaggttttgaagtgggccaaagtgtagatatcattcattggttagagtgcagggtgaagtcatgggacaggttgaagaagaagctgtattntcatgctgattctgttcctctctgggggtcttcaaactggttagcatcagctgttctgctggaatttgacatctgaaaaacatccgaagcaattcttaaaagccttatggttctaaggtcagaaattttatctacaggaaaatagggatgcaaattttcggtgtctactgctacatgactttcggttacaaggaagtaggtctaagttcagcttcattaatacttaattataactatctttctgcccagaattcttgttaaccctgtgaggacagcttcatataccctaaattcagaatctgtcttagtaatggnttttcaggaagttgataccaatgtaaccgcccaacgggttcaccttgtcctcngcctagacaaagctgatttatcaagatgggaattgcaatggagaaagagtaattcacacagagctggctgtgtgggagactggagttctattattactcaaatcaatttccccatattcggggatcagagttttaaagataatttggcaggtaggggcttgggaagtggggagtgctgattggtcaggttggagatggaaacactgggggttgaagtgagatgttcttgttgtcttctgttcctgggtgggatggcagaactggttgagtcagattatgggactgggtngtgtcagctgatccattgactgcagggtctgcaaaatatctcaactactgatcttagtactgttatccccaggagcaatttggggaggttcaaactcttggagccaaaagctgcatgacccctaagccatcatttctaatcttgtagctaatttgttagtcctgnaaaggcagactggtccccagacaagaagggagtcttttcaggaaagggctattatcagttttgtttcagagtcaaaccataaactgaattccttgccaaggttagttccagcctacttccaggactgagcaaggacagctgaaaggttagaagcaagatggagtcagtcaagtctgatctctttcactgtcataatttcctcagttacagtttttgcaaaggtggtttcagtccttccctttgggtttaacagcaccttattcttaaggtgtgggctatgaagttgggaaagggccgtcagtcactctggctgctttctcctaactgggcgtagtgggggaaggtgttgaccacaaagtgagaggagtggaactgctttgcagctgtctgagtgtactcacgcaagccaggctgaggttccaaggcttcatgacaaaggtgttagtattctcatctatggttttagtacagcatttaagtggacatttaaatactgagttctaggataaggagtgcaaattccagttaagcattaatttggggcattgtggctcaccaaaatctaaattgcagagg

SEQ ID NO: 106033 - DNA, 489 bp, Homo sapiens
ggactaaaaagaagagtgggtaggtgaatatcagaaaatgggctcagtaaggcagaggtaagaggaggggtcatcgtatggccttgtaagaaacaggaaagactttgccttgatttctgatgatgcgttaacactttatctcttctacttttctttcccatgagtatttggttactctctctgactcccacaagcccccaaaatggtactcaggaataaaataatttatcaaacacgggtaacgactactgctagctaccaggatacaaaatctattaaacatggccatcgagaggtgggacagtatcatgaaaaccttctagattatacttataataagccaacctatttctaactcagtaattttttaaattgatttttccctgaatcataagagtaatgatacaagagaaactctctcttctccaacccaatcaatcaggccagtggttggatcatccagggtgtgggcagactagagattagcca

SEQ ID NO: 106034 - DNA, 421 bp, Homo sapiens
cagtattccatgagcctcttagtttgaaattctgaggaaatgtgattgattacttgccatccagtagattgggttggctcccattgagataggtacttactcctatctcatttgtctttggccaaatagttgactgccaaatattgcaggagcattttctagagaagagggctatgacttaagcagtcatttcaaagcgtatctactacagctctccttttttatgtcattcattccacaaacatttatggaatacctgcttaggtgctggagcaatttaataagaccaggccaggcatggccaggtacaggctcatgcctgtaattccagtcctctgggaggctaaagcaggagtattgcttgaggctagcagtttgagaccagtccgggcaatagagcaagaccctgtctctacaaaaa

SEQ ID NO: 106035 - DNA, 1100 bp, Homo sapiens
  misc_feature (4)..(5): n is a, c, g, or t
  misc_feature (9)..(9): n is a, c, g, or t
  misc_feature (547)..(547): n is a, c, g, or t
  misc_feature (1077)..(1078): n is a, c, g, or t
  misc_feature (1081)..(1082): n is a, c, g, or t
  misc_feature (1084)..(1085): n is a, c, g, or t
  misc_feature (1094)..(1097): n is a, c, g, or t
  misc_feature (1100)..(1100): n is a, c, g, or t
caannattnggcacgacagataagttgtaggaggattacaacatttttcgtatgaagcaaggtgcatatgccacagcaattggtttgattgattatggatttctgcattccaagggaagttactttattactccatgaggatgggtagtgatcttaggggtcttatctctggcaccgtttggtctcaattatttacaggaaaaagaggcttttaaaaaaggcaaaagttgcagctgcctgccacctggctcaggctgcagagccacattcctctcaaggctcaggataacttaaagttccaaaaactgtaagtttaaactatttagtttcacagctactataatgttcagtttcctatctttgtatagttacctgggtaaccaagactctaaccctagtaatttctcttttctcttcttgttagaccatccgctgggctcattccaattcctacccgaccctgctgctttatgatgaattggcctttaccaatgaatcactttttaacattaccctgcagttgacaatttgcctctctgtaagccanattgcttcttaactagacattggccttgtcgctgaacctccttcatatatttgagtacaacttaattgtagcaaaatagtttcaactgtgttaaacccattgggttttctttaggggtctttctggagaccctaaataataacacatagtcagctgcaagattttttattgtaagactaactttgataccagcttgccatgtctaagaaagtgaaaaagctaatgcataaatagaaaatttctaaggctagctgtctcttgatcttggtatctttggagccaagacaagaaaggcaggataaaccttgctcaattaagctatctttgaggaaccagaaaacaaacaaaaatcccaatatagtgatttaaaaataaaccctaagcaggaaggatgaggatgtctattacttagtatgagaaagaaattgagcagattggaacgtgacaccaattcttggactcagcgagttgattctggagaggtaaagcaaagacagttctcttcaatgcagtgaacagagaacaggtannggnngnnttattaagnnnngcn

SEQ ID NO: 106036 - DNA, 472 bp, Homo sapiens
gtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcg

SEQ ID NO: 106037 - DNA, 179 bp, Homo sapiens
ccttagcccttataccattggacatatgacatgttttaatttttagaaaattatttttctctactgaataaaatataagctccatgaaggcaggagtttttgtctgctttgttcactttttattcttgtcttgtagaacagttcctgcacagagtgtgctgtcaataaatacttgttga

SEQ ID NO: 106038 - DNA, 1535 bp, Homo sapiens
ctgggcaacagagcaagactccgtctcgaaggaaaaaaaaaaaaaagaaaagaaaaaatgatgttgatgatgatagcaaatatgtagtgttttctgtgtcaagttttggtgtgtattaactcttaatcttcacaataatcttattagatactattattatccccttttacaaacgaggacactgatgcacaaagatttgaaaacttacccaaggttacttagccagtaagtgatggagtcaagatttaggattcaaatctagatgttttggtttcagagcacttgcccaatcctgcctttctaaagtaagacaaatggtgtcagacaagtgccacattctagatttaatcaaggcacagagaagacagatgttgatcctgcctgaaggttttagggaaggttcctggagcaccctgctcttcagggccacccatcacctggccctccatccctttctgggactctttggagccctttctcccacacagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgca

SEQ ID NO: 106039 - DNA, 809 bp, Homo sapiens
atgatggggtgggggaaggaaagcatggctcagaagctctaacactcccctccctccagatcctaagaggaagcctttcttttgagaagtcttaaagactacccatcccaaattctaggaaaagagaagacccagcccttctcccctctaatccccccatccctttccatctttcatctctttggtatgggaagtttcccttgatctccaagggaagcttcttttctgttgcagccttacttagcctcttgccctgtcttgggtgaaaggcctgagttatttaaggtgggaaagtgacctgaagaggaggtttccctgtcggggagcgcggctgagtggggtcggggtggtgatggctgacagggcccctcctcactcttcctccagggggagctcttaagcccctgccgctgcgacggctcagtgcgctgcacgcatcagccctgcctcatccgctggatcagcgagaggggctcctggagctgtgagctctgctacttcaagtaccaggtcctggcgatcagcaccaagaacccactgcaggtgaggtgcaaggagaggactcggagattgggcgaggaccttttagctattggactcagggaccctccaggaagcctatttcatttactcttttcccaaagccacccttccccgccagttaccagtctcccgtgtgtctgtatatccttcctaagcccttaatttattcacagagatatttattgggtgccacttatattccaggcactgttctaggcactgggacaatcaccactccccacccgccacaaaaaaaaagaaaaaag

SEQ ID NO: 106040 - DNA, 2533 bp, Homo sapiens
ctgggcaacagagcaagactccgtctcgaaggaaaaaaaaaaaaaagaaaagaaaaaatgatgttgatgatgatagcaaatatgtagtgttttctgtgtcaagttttggtgtgtattaactcttaatcttcacaataatcttattagatactattattatccccttttacaaacgaggacactgatgcacaaagatttgaaaacttacccaaggttacttagccagtaagtgatggagtcaagatttaggattcaaatctagatgttttggtttcagagcacttgcccaatcctgcctttctaaagtaagacaaatggtgtcagacaagtgccacattctagatttaatcaaggcacagagaagacagatgttgatcctgcctgaaggttttagggaaggttcctggagcaccctgctcttcagggccacccatcacctggccctccatccctttctgggactctttggagccctttctcccacacagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgtgggctggggaaggctggagccatctgccttgttctggagatcatctgggttctatcagtccttctcaagtactgtgctcacccagaaaagcagtgtgaagtgaatttggactcatttggagtgagatggagggaatccccccactcagtgttatgagtctccaaccccagtttaagctatttccatggcagtttagggtcacaggtttgatcccggtgtgcccagccagtggtattaatggatggcattatgtttggaggcagcagcatagaggactgttgtttatagagaaaagatttgggaaggactgtttacaatgtgggtcagcctgaagcctgggcactttcttctgtgaccttggggttgtgtattatatgaatgatgctgtttttaagtaaaccattcaacagcaattaaataattccttcattcacggctaaaaaaaaat

SEQ ID NO: 106041 - DNA, 2397 bp, Homo sapiens
cgaggaggagtactacgggtcggagccgcgggcccggggcctggccggcgacaaggagccgcgggccggacccctgccgccgcccgcgccgccgctgccgcccccgggcgcgctggacgccctgtcgctcagcagtagcctggacagcggactccgaacccctcagtgccggatctgcttccagggcccggagcagggggagctcttaagcccctgccgctgcgacggctcagtgcgctgcacgcatcagccctgcctcatccgctggatcagcgagaggggctcctggagctgtgagctctgctacttcaagtaccaggtcctggcgatcagcaccaagaacccactgcagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgtgggctggggaaggctggagccatctgccttgttctggagatcatctgggttctatcagtccttctcaagtactgtgctcacccagaaaagcagtgtgaagtgaatttggactcatttggagtgagatggagggaatccccccactcagtgttatgagtctccaaccccagtttaagctatttccatggcagtttagggtcacaggtttgatcccggtgtgcccagccagtggtattaatggatggcattatgtttggaggcagcagcatagaggactgttgtttatagagaaaagatttgggaaggactgtttacaatgtgggtcagcctgaagcctgggcactttcttctgtgaccttggggttgtgtattatatgaatgatgctgtttttaagtaaaccattcaacagcaattaaataattccttcattcacggctaaaaaaaaat

SEQ ID NO: 106042 - DNA, 2588 bp, Homo sapiens
atgatggggtgggggaaggaaagcatggctcagaagctctaacactcccctccctccagatcctaagaggaagcctttcttttgagaagtcttaaagactacccatcccaaattctaggaaaagagaagacccagcccttctcccctctaatccccccatccctttccatctttcatctctttggtatgggaagtttcccttgatctccaagggaagcttcttttctgttgcagccttacttagcctcttgccctgtcttgggtgaaaggcctgagttatttaaggtgggaaagtgacctgaagaggaggtttccctgtcggggagcgcggctgagtggggtcggggtggtgatggctgacagggcccctcctcactcttcctccagggggagctcttaagcccctgccgctgcgacggctcagtgcgctgcacgcatcagccctgcctcatccgctggatcagcgagaggggctcctggagctgtgagctctgctacttcaagtaccaggtcctggcgatcagcaccaagaacccactgcagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgtgggctggggaaggctggagccatctgccttgttctggagatcatctgggttctatcagtccttctcaagtactgtgctcacccagaaaagcagtgtgaagtgaatttggactcatttggagtgagatggagggaatccccccactcagtgttatgagtctccaaccccagtttaagctatttccatggcagtttagggtcacaggtttgatcccggtgtgcccagccagtggtattaatggatggcattatgtttggaggcagcagcatagaggactgttgtttatagagaaaagatttgggaaggactgtttacaatgtgggtcagcctgaagcctgggcactttcttctgtgaccttggggttgtgtattatatgaatgatgctgtttttaagtaaaccattcaacagcaattaaataattccttcattcacggctaaaaaaaaat

SEQ ID NO: 106043 - DNA, 1711 bp, Homo sapiens
ctgcccacgagtgcaagattgtattaccgcagcgctgaggcaagagcgtccgcatgcgctgggcagctggggggcggctcgtggccccagaggtggggcccgtccgtgagttcctggggcctgacttccctgccgtccctccccctgcatctcctcctatgtccttggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggtttctctgcacaggttgcaaatcccaaatgcagcagtgggttctgagttgtaggtgtgactcccacttgctggtgaataattcatgttggctgctaggtggcagcactccgaggtatctaaagggtagacctggacctgccacctatgagttgtgtgatatagaaaaaaatctcttagctctggttttcctgtctacttcatagggttggaataaggataaatgagggacaggttggatgccgttgcagagaaaatcagcaatgacataaagagatttctagaatagttgatggtccatttatttcaaatagtagctggtgtaacaaattctaaaatgtgtttttcatctggagttgcacagaatcatggaattttgtgttgagtgacataataggtatggaaatatgaggggaaatagacattgcaaatgtgaagcatggtggttatttgttaagaatgagaactcctctgactctaaatatttgggcctgtgggctggggaaggctggagccatctgccttgttctggagatcatctgggttctatcagtccttctcaagtactgtgctcacccagaaaagcagtgtgaagtgaatttggactcatttggagtgagatggagggaatccccccactcagtgttatgagtctccaaccccagtttaagctatttccatggcagtttagggtcacaggtttgatcccggtgtgcccagccagtggtattaatggatggcattatgtttggaggcagcagcatagaggactgttgtttatagagaaaagatttgggaaggactgtttacaatgtgggtcagcctgaagcctgggcactttcttctgtgaccttggggttgtgtattatatgaatgatgctgtttttaagtaaaccattcaacagcaattaaataattccttcattcacggctaaaaaaaaat

SEQ ID NO: 106044 - DNA, 1737 bp, Homo sapiens
  misc_feature (1613)..(1613): n is a, c, g, or t
  misc_feature (1620)..(1620): n is a, c, g, or t
ctgggcaacagagcaagactccgtctcgaaggaaaaaaaaaaaaaagaaaagaaaaaatgatgttgatgatgatagcaaatatgtagtgttttctgtgtcaagttttggtgtgtattaactcttaatcttcacaataatcttattagatactattattatccccttttacaaacgaggacactgatgcacaaagatttgaaaacttacccaaggttacttagccagtaagtgatggagtcaagatttaggattcaaatctagatgttttggtttcagagcacttgcccaatcctgcctttctaaagtaagacaaatggtgtcagacaagtgccacattctagatttaatcaaggcacagagaagacagatgttgatcctgcctgaaggttttagggaaggttcctggagcaccctgctcttcagggccacccatcacctggccctccatccctttctgggactctttggagccctttctcccacacagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctggccgagaggttgtcatgagggtcactacagtctgaactggactccaggagcagggatcttgagtcaatgcatcagtcagagaagaactctcatggctgctggaggtaccagctggacaaggtgtttggggcatgctgcccccgtcaccgaggatctgtgtgggtagcctcaagctggagacattgtctggcctcactgcccactgggtagagacacctggatgacatttcagtacccgctggcagctcctcccactcatccagagacggccggtgggcaggcggggagagcagctttccttccctggagagaaccgtctttacctcagctcctagggcctccagccccccagctccaccacggtgacttggtgaagggggaccaatgccagaagaaaggggctgtagacccctattccccaccccatggccacagggcatctggcaataagactagtatacattgacctcccgttccctgcatgagggcggggagttccccctgctccatcccccattgcatgggggaagggcataaagaatcatttatatgcacgtggagactcctttctcatctggggcttttctggagggttgggagatgtggggaggttttttttttcttttttcttnctttctnttgcttctttgtgttctttgttcttctcgttttgtctcctttcttttctttcgtttgttttctgttgttattctctccctttttgtgccttttcttctttttactaatccttgtttt

SEQ ID NO: 106045 - DNA, 921 bp, Homo sapiens
gacaagtgccacattctagatttaatcaaggcacagagaagacagatgttgatcctgcctgaaggttttagggaaggttcctggagcaccctgctcttcagggccacccatcacctggccctccatccctttctgggactctttggagccctttctcccacacagtggcaggccatctccctgacggtcatcgagaaggtccagattgctgccatagttctgggctcgctcttcctggttgccagcatctcctggctcatctggtcctcactcagcccttcagccaagtggcaacgacaggatctgctctttcagatctgctacggcatgtatggcttcatggatgtcgtctgcataggtgagggcacctctctctcctttacctgctctgtatcttcctcttacacacctaactcccctgcccatcccctcagtttcctggctttattttctgccactgtagcctttagtgctatcctggtgccccctcaacccacttccctgcttctccagggccctttgcaactgtatcttctcactctgaagaaatgcttgcttaagtacctctggcctagatctaggccacagttaaccctggatttcttattcctattgctcaggcctcatcatccatgaaggctcctctgtctaccgcatcttcaagcgctggcaggcagtgaaccagcagtggaaggtcctaaattatgacaagaccaaggacataggaggagatgcagggggagggacggcagggaagtcaggccccaggaactcacggacgggccccacctctggggccacgagccgccccccagctgcccagcgcatgcggacgctcttgcctcagcgctgcggttatacaatcttgcacctccttgggcagctgcggccaccagatgcccgttccagctcccattctgg

SEQ ID NO: 106046 - DNA, 647 bp, Homo sapiens
cctataacagagcagagtatcttatgtgcagtaaacattcaatattggtaaactggcttgaccaacactagaaaagtgcatgaaagaagtcactgtttcctgaattagccttgtagtttcaaaaggtaaatcaagaataaaaatggtttcatggtcaaataaatttgggaagcagtgtatattttattcctatcttagaaaatcacagtgcaccctagaatatcaaaagcctgtgacatcttgaaggagagaatctagttatattttcttcaatccagtattttccaagttaatattatatacctttttcaaaaatttattttttgagggtacctttttaaaacattatttgtgaaactatgtttgaggactatgtttttcagaatgtttgggaagcattgccatatcttcctctaggaaaaaaaatcagtttttaatcggaaaatgggaggagtgctttccacaaatgtgtcaaaattcttcctcacttaagtttaagaaactgcaaaacagagattgtacataaattagttattgccttcatatagaataaacatagtattcttacttcagctcatgatctgacacttaatttagtaatacttccgcccaaaaggggtgtgacatttatgcctgctctttgtact

SEQ ID NO: 106047 - DNA, 390 bp, Homo sapiens
cagttcctagggaggcagttctccactcagtcccctcaggttccaggtgtggaggaggtgtggtgactgactgtggccccgtagagagtgtaggctgcaggaattcaggaattcatcccgttgcatttgccctcccagagagagctctaaccagttttctttctgggtcaccgaagcagtaaggcacaccttgccaaggtgagcattatttttttctcagacccagcgtcttctaatctactttgggggtcatgtatttccccttccaccatggctttggccttgatccttttggatctagcaaccctggcattgctgtgctaagaagcatgtggctcttgcccatccagcgtgagcccagtttgccctggtgattgccaccttccccta

SEQ ID NO: 106048 - DNA, 641 bp, Homo sapiens
caatcctcctgccccagcctcccaagtagctgcgaccacaggtgcacgccaccatacccagctaatttttaaattatttgtagagacaaggtctcactatgttgcccaggctggtctcaaactcttgagctcaaacaatcctcccacctcagccttttaaaatgttgggattacaggcatgagcaaccatgcccagccagaaagggattttaaaagacctgttacaaatatgctcagtgatttaaagaaaaagatgaacagaagaaaaatggaagatctatagatgaaccaaattccaggtctaaaaaatgaaaaatgcaatatctgaaataaaaaatccactggatgagcctaatagcagagtgaacatgacagaagaaaggataagtgaacttgaaaaactagtaaaagagattatctaaactgaagcacagagaaaaaaaatgcacagtgtctgtgacctgtggaacagcctaccatatatgtcactggagtctaagaataaaaggagagagaagcagagaggcactaaaagcgtttgaaaaaataatggctgaaattttttaaacttgatgcaaactatgcaaacaatgaacatccagcaggatgagcatgatataaactacatcagagcacattgt

SEQ ID NO: 106049 - DNA, 232 bp, Homo sapiens
gtttttttaaatgaaaagacaagagatgtcaaatttgctgacccttttttgtatgacaagtgactatgtaatctgcattgcagattaaacaccaagcaaccaaccaatcaatgcaacactgttacttcatttcttcaaggtaaaggtaatgttttaacaaggagtgaaaatgtaactgccttttctaaaggctgggataaaaacacagaatgtttttaaaatcactgtttgg

SEQ ID NO: 106050 - DNA, 332 bp, Homo sapiens
cgctatgttgctcaggctggacgggaacttccgggctccaagtgatcctcttgccttagcctcccaagtagctgggactacaggtgcatgcccagcaaaattagcgatttcagtcaatacaagaaatatgtccaggaagataaagaatataaaatttaaagatactgaataaatatccatttcgctaccccgcctacttgtcctaagataattatatataaaaatttaaataccaagttcctaaaggaatcccaaaaattcaaacaatgggcttttgatacaaatatagtctttgaacattctgttaattggtgtcctgtgccaggtataca

SEQ ID NO: 106051 - DNA, 420 bp, Homo sapiens
gaagaagactaaatatatatttcacaatatcacaggtatgataactgtactctagcaatgcttgacattttctccacaatggaatttaaaatactaaaaattaaaatatatgaaaataaaccaaaacatgagggccaatatatatacaaaataattattaacagtattattttatccaaaaaaagttttacaaatatggaaataaaaaggtcaatctctattacggtaaaagaaaatgaatattctggccgggcacagtggctcacacctgtaaccccagcactttgggaggccaaggcggatatatcacctgaggtcaggagttcaagaccagcctgggataaagactgatgaagagtctgtaacaaatcaaaggtagagaatgagacaagggttctgaatggaacttctgaaaacatt

SEQ ID NO: 106052 - DNA, 613 bp, Homo sapiens
atagctttgtatattagtcagctattttcaacattgcctatcatggtgctttgcaagtggttactcagtagttatttgctgcatgaacgaatgtctcttcattgagtcactgcatcagtcacttccctcctaacgtttcaggggatctttccttttcctcccatctctatccttttggttattttccttcttgtttgcatttcctctggagggtagaccaagaaggcaaaggagatgagtccaaaaccattctgttgtttattagtaaccctgataagaaaaaaagtattatatgagaaaggattgaaatatttggtgaaaatcagattttggagttaatgctggatttcattttttcattctgtatctcccactactagttatggattcggtttttgctgttttttcttttcttcaaagccctgaccatcttttttttctttaatttatagctagtgatgtcctcttacattttattttatttctcatttttataactttttccccctccatatggaagcctcttccatgtggagtcctaattcgggaaaaggagtcaggctggcgggaccaagggaatgcaaaaagagaaagcagataagctgtaactgcc

SEQ ID NO: 106053 - DNA, 411 bp, Homo sapiens
ggctgcagggattactgaggcattcatactgatgggaaagttgtcgtgaaacctaatatgagataatagaagcatctggcacatcatctcctgccgccctctactgcacaagaagaggtttgagatcacgattcagcctaattactgaacttgtcattatcatgccctatgctcagtgagaggctgctgtgtaccagcactgtgctaaagggcttcacagaaattatttcttgcaatcttcacagcaatgcttatgagataattattatccccattggattgatgagaaaactgtgatatggagagatgaaacagcttgtccaaagcatattcttacaaaaaggcagggctccactgcctccctattcatggagtcgcagagctgaaaggaactttaaaaattacctggac

SEQ ID NO: 106054 - DNA, 107 bp, Homo sapiens
agtataactcagaataaagaagaaaagccacagcgaccttcctcatcagcttctacaagcgttcatccagaaggctgccgtgttattgctggagctgctgtaaccag

SEQ ID NO: 106055 - DNA, 132 bp, Homo sapiens
acccggccgtcgccggcagtcgagagtggacgggagcggcgggggcggcgcgcgcgcgcgcgcgtgtggtgtgcgtcggagggcggcggcggcggcggcggcgggggtgtgtggggtcctcccccgcccccg

SEQ ID NO: 106056 - DNA, 425 bp, Homo sapiens
agtgctgggattacaagtgtgagccaccgcacccagcctccttctcttctaaatctacctcatacatttcctgtgttgttccatcatcttcaaaactgaagtcttccatgactgagaactgcccatcaagtgccccaatgatgtggagaggctttgtttcgtcccctaacggggtgggatcagaatgtgttctggaagcctctgggcctccatgtggcctgctggagatgcgggtttccctgccccaaggcactgatcccaggaacccacaggtgccccagagaaaggacctgaagttgctaagagggacacagatgctgccagatttgtgtctgggaggagcggctcctaataggtgacaattattcctagactttccaactgctcacattgggtaagactttcaaagccaattattttataag

SEQ ID NO: 106057 - DNA, 293 bp, Homo sapiens
gatctagaggatccggctgagcagctggcaggtggaaaaaaaaaagtgccactggcgacaggagggcccagctggcagaccccccaaccacatcagaggagttttcatttaactttactgttcggacaaactattctcatctgacctcataacggtctctttaatcataggaacagtttcaagaaggttgatttgctcaaggtgatacagctgttaaattacaggacaaagccttgagcccaagttcctaagactctctgacacctgcaactgtggcactgccagctcgctca

SEQ ID NO: 106058 - DNA, 95 bp, Homo sapiens
atgacttttccctgccaacccagcacagtgaacagataagtcagaagagtctgggagcaggaccctgaaagatggatgtgatgtcgactttcatg

SEQ ID NO: 106059 - DNA, 158 bp, Homo sapiens
ttgccttcactcgggatgcctctttgactcttttcatctgaaacagtttttgagtctttgtattctttgacattggcatttttgaaaagtacctgccagatattttttaagatgtctaaaaattcctttttaaataaatttaagttttaaataagtga

SEQ ID NO: 106060 - DNA, 323 bp, Homo sapiens
gtttacctatttgtaaaatgtgatactggagtagagtattcttgtcctttctcttacctaagacctagctaatcagaacaggtgatatcacatgtagatccaggttctggagctctaccagggcagttccattttctatttagaatcagcttgagtctttcctacctggatcaacatatggtcatcagtctatggtcactaggaatcctctcacaatcacccgggaatctttaagacatttcaggatgtcctgtacagacttaggtcagactggcaggagtgcctaattctgcttccatgttagaggaagggaaatgagtcat

SEQ ID NO: 106061 - DNA, 1018 bp, Homo sapiens
  misc_feature (848)..(848): n is a, c, g, or t
gctggtgtctttgcttacagaatacagtcaatccttgcccagatgatactttgatatctttcttgcctctcgcccatatgtttgagagagttgtagagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgaattttcggacaagcaaacaccacgctgaagcgatggctcttggactttgcctccaagaggaaagaagcagagcttcgcagcggcatcatcagaaacaacagcctgtgggaccggctgatcttccacaaagtacagtcgagcctgggcggaagagtccggctgatggtgacaggagccgccccggtgtctgccactgtgctgacgttcctcagagcagccctgggctgtcagttttatgaaggatacggacagacagagtgcactgccgggtgctgcctaaccatgcctggagactggaccgcaggccatgttggggccccgatgccgtgcaatttgataaaacttgttgatgtggaagaaatgaattacatggctgccgagggcgagggcgaggtgtgtgtgaaagggccaaatgtatttcagggctacttgaaggacccagcgaaaacagcagaagctttggacaaagacggctggttacacacaggggacattggaaaatggttaccaatggcaccttgaaaattatcgaccggaaaaaaagcacatatttaagctggcccacaggagaatacatagccctgaaaaaggattgaacatttctacatgcgaatngagcgtgctcaggggaggccaagaaaaagcggagcattccatgccatggggaccgcagtgcacatcagtccggccccacagagagaaacgcgagaagggaacacgtcaaaaatcccaacggccagaagccgcgacacagagagacggcatactacacaggacaaagaacg

SEQ ID NO: 106062 - DNA, 361 bp, Homo sapiens
aatgtccccgtgcctgtcttctcatcttctcgcctggttggcctttactccctaagtcaggaaatcctccccagaagccatggccccagctggccaggacactctgaggttggggtggggatcgggggaattgccccaggactgtgttgtgatgctggtgtctaggaggtttgcaggtccagctgaacaccaagaacaaagctttgccaagctagacaagcctggagtccttggacctggccgggcaaggtggagggagggggcgtggagaatcacaggaggccagaaggcaggacacacacctctggaagaacggagcacaggtcagtgatgcagaggaggctggttaggcggccaaggg

SEQ ID NO: 106063 - DNA, 499 bp, Homo sapiens
tagcaattattcattcatttttattgctctatattagcatttaattatgtaaacacacctcaagtcttctatccactgtactcttggtttccactttcatttttccagtttttctcccttacatataatgctgtaatgaatattcttgtatttgtttttcagtgaatatacacatgcatatcttttgtggatagacctatttgttctgggccataggttttacatatgttcaactttagtagatactagaaaacagttttccaaagtggctataccaattttcatactcgctggcagagtatgagagttccagttgctccacatcttcatcaacatgtgttactgtcaatctttgtaatgttagtcatcttggtgataaccagtgaagttagatgccttatcttatgtttattggccatttggatatgcttcttttatgaaatgctctttcaagtcttttgttcattcttttaccttatagcaatgtcacgaagatact

SEQ ID NO: 106064 - DNA, 338 bp, Homo sapiens
tctacatgctcttcttgatttgtgcataatgaatatcaaccattgacttcagttaatggtctgaatggccttaatccctatcctcaaagcaatttacaagctacttagagatgcaggagttggatacaatgcacgtacttcaaggctgtgcattgttaggtgccaaggacaagaagaaaaacgccatttcttgagatgccttccccatctctaatacagtgagtacaatcaccaacattttattgcagggatacagagactcaatttaaggaatgtgtccaaagccatacttggtaaatgacagacataggaggtataactgacacaccaactcatgc

SEQ ID NO: 106065 - DNA, 316 bp, Homo sapiens
cctccccagaacccagagagccggggcagaaaaaacgaatcctcttagacatccctgtgggctgagcacgggttccctctgtccttaattgtctttcctccatgaggaggatttacttacagaggagttttcagtgccaagatgcttataagaaagctcttaagctttttgatgtgtttgttacctggtttcataccaggggtctcagaaggcccaaggatgaggagccagcgtgggagtgtgggaagtggaggaaacgtggtcatgaaaacagtgcattctccttgtttagccagaaggaaaatgaaatgttgca

SEQ ID NO: 106066 - DNA, 438 bp, Homo sapiens
gtagagacggggtttcactctgttagccaggaaggtctggatctcctgacctcgtgatccgccctcctcggcctcccaaagtgttgggattacaggcatgagccaccgcgcccggcctgattcttaaaatacccatttacacagcactaatttgagaatcataaaggggctgtccgaaataggattggggctgtctgaaataggattggggttcacgagatcaagccattgcattccagtctggacaacaagagcaaaaactctgtccaaacaaaaaaacaaaacacaactacaaatggggggaccaggtatggtgactcacacctgtaatcccagcactttgggaggccggggtggatgcatcacctgagttcagaagtttgagaccagcctgggcaacaaggtaagaccccatctctacaaaaaataacctgggtg

SEQ ID NO: 106067 - DNA, 459 bp, Homo sapiens
gcttagaggatccggctgagtgcatggtcatgctgtaatcccagcattttgggaggcaaggcgggcggatcacttgaggttagagttcaatgaccagcctggccaatatggtgaaaacccattcttttataaaaattacaaaaactagccagctgtggtggtgggtgcttataatcccagctactcaggaggcagaggcaagagaatcacttgaccctgagaggtggagattgcagtgatcccacaccaaccaagatccatactttggcagggtggggtgtcattcatattgggatgttgctgttcccaagcattctcagaggatggagctgggaaatagacatatacatatgaatagaaatagacacacacacacacagcctcaacatctctttctgtctgtccaccttaacagtcactggcccacactgacaccactaatcccaatccaccattgca

SEQ ID NO: 106068 - DNA, 269 bp, Homo sapiens
acatgaaaaggtattcactatacagtatgtgagaaaaaaaatcatacaaccctaaatttataatcagatattcagaaagacaggcctttggtatataccaaaagttcttatttttgtttggtggggttatacatgcattctttgccacttatccatatttactgaattatctacatcgagcataatgaatttataattaagagggaaaaattattaataataagaatacaatgaaatgttttatatgtgtgaggctagggagagcacag

SEQ ID NO: 106069 - DNA, 222 bp, Homo sapiens
tgcacacataaccacccactcagggaatgacaatgtaaaatgtagtaaaatattaccatttgaggaatttgagtaaagggtatacagggattctctgtactgaaattatgaaacaaatgtgtttttctaagtagtttatatgacagaaattttcaaagtaactttcatcatgtgaattttctcaacaggaaggttgataaccttgaaaattaatgggaaaca

SEQ ID NO: 106070 - DNA, 355 bp, Homo sapiens
tttcctcacacttttggagggcagaagtccaagatcaaggtgttggcagggttgatttcctctgaggcctctttcctggggttgcagatgaccatcttctcactgtgtcttcacatagtccttcccccgtgcaccttttaaggacaccagtcagactggattagacccaccctaacaatctcattttatcttaatcagctctttaaaggccccgatctccaaatactgttctattctaaggtactgtgggttaggacttcaacatatacattttggggaacacaattttgcccataacaaagtgctgggattacgggcatgagccactgcgcccgccaagcccctttgttttaat

SEQ ID NO: 106071 - DNA, 858 bp, Homo sapiens
ggctggcgggaccagctgcttccggctgggctgcgggcgtggactcctcattccggctgtggccgcgccgctgcggggcctgaggccctcttgggttttggttcagcgttagttaacggttaacccgccaaggcgggcttccgcccaggcacaggagactcaccgagcttgttcaccttgaaacttgggccacacctgagacctgccacctaaggggggtacgcgggtcgtttttaacaagctttcatggcatttgtgccatgaaagctctaaagtatagaagctgctccagggcttccgcagccccggccgtcctggagatactcgcctcctggagtctgtgtcgagaatttgcagcacctggacagccacgtgcagtctcagaactgcaggcggtctttaccgaaatgttaaacacaacttgaagttaggcaggataactgccagagctggatggaccttagaggtgccagctaacgcgctgtgagcgttttctgcggttaggcctgctctaaacatttgacatgtgttaaagcatttatgtgctttacccacacccctatgtggcgggcccttcttaaagtaaaagaaactgcagcacagcgaagttaagcaacttgccccaaatcacgcagaactgggatgcaaacccaggtctagctcactcgtgatcacaattcaacatcatacgatggtgctgatttccagagcagctctgtgactttatataaaattattgggcaagcgttcaattgtaaacattcgtgaacatagctgttgcacattagcgttcctttttttttttaattcaggaccatctttggtgacaaatataaatatcaatactatatatatcac

SEQ ID NO: 106072 - DNA, 255 bp, Homo sapiens
aaaaagcagccttcactcacagggctaataagaagccaaatcttcagaggagagccagctctcagccttggagcaagaagctgaagggtagagtcagagaagttgatcaaatagtgggttgtactaataaccatgagcttttgtactagtagccatgagctttgatgtaagctcatgggtattaatgcaaccctctatttgctcaactgaaagttgaaagtgaaagaacttcagcagttaggtcatagtggatag

SEQ ID NO: 106073 - DNA, 451 bp, Homo sapiens
agtcccagctacttggggggctgaggtgggaggattgcttgagccctaggagtttgagaccaggcctgggcaacatggtgagaccccatctttataaaacagttttgttcattcctggaggtccctctccctgtcaaatagcatccagtttttgtttcatagttatagtatattttcttaaatatctaaatatagtagtaacagttctgggggttttttggtttttgtttttgtgtagagatagagtctcaccctgtcaactaggctggagtgcagtggtgggatcagggctcactgcagcctccacttctggggttcaagcaatcctcctacctcagcctcctgagtagctgagatcataggtgtgcaccaccacacctggctaatttttaaaaatgggttttttttttttttgtaaagatgggtctcactatgttgcccagaaatcaaa

SEQ ID NO: 106074 - DNA, 1091 bp, Homo sapiens
tactctattaaaagctctagttgttctctgctctcctcacttatctgactctgaaatcttctaaatggtacccactttatttagaacgttttagggtcaaataagtacaggttggaatcctgagtgcaccacttaactattgaggctgacagccagtgtacacctgggtcttcacttcccctgccccatgactcttcattgtcttagtcccttctatggacctccctatgatacctcagctaaaagtttgaagcagaacccagctcctctagcaccagctagtgtctgttctgagtggccgatgctggtacaagtatgagttattaaatatttttaatttcaccctgtttattatatgtatgattttaattaagttacttgtcctttctgagccactcccagatctttaaaatggggataataatacctgttttgcaggatgactgttcattcatcaaatatttgttgaaggcctgccttgttctaggcaatgacttaagtacttgggatatattggtgaacaaaacagaaatgtctgtgccttcttggatcatgtgttttagaattatgagaattaaatgaaaataaatattcaatatggtgccagacacatagaggtgcccacagtgtcttatctcactttcttcctgcttgccatatcttttccatcagggccaaagagaatgggaagtgggaagaaataaacttcatatttcatttgtatagctgtggagagtagcaggccctgggtccctttggggaggtcatgcgaactgggcatggccttctgtcaagaattattagaccaggcatggtggctcatgcctgtaatcctagcactttgggaggctgaggcaggaggattgcttgaggccaggagtttgagaccagcatagccaacatggcgaaaccctgtctctaataaaaatataaaaattagccaggcatggtggcacatgcctgaaatctcaggtctccaggaggctgaggcatgagaattgcttgaacctgggaggtggaggttgcagtgagttgagattgtgccattgcactcccacctgggcaacagagtgagactcttgtctcaaaaa

SEQ ID NO: 106075 - DNA, 716 bp, Homo sapiens
gcacaatgtggttattttagtgagaaaataagtcttaccttggtctcagtcttgcaatgtaacctgaacttatttgcttaaccactctgagttccagtgtgcgcactggaacttacttagcattcttacttagaatgtgaaagtcaaaataagagtatgtaaaaagatatgctgagatgtttccactgttacacaaatgtaagggttggatgttatgtcctcatctcctgtctggctcttctctctctacctccagcctaatcttccccttctccacctcactgtcctcagcctcactggccttcattaagttctagaaagagttatcctctttcctgcctcagagccttaacacatgctgttccctgttcctgtaacactcttctctttttaaattattattatttaatttttgagatgagatccactctgtcacccaggctggagtgcaatggcacaatctcggctcactgcgtccaccacctcctgggctcaagcaattcttccacctcagcctcccaagtagctgggattacaggtgtgcaccaccacacctggctaatcttttttgtatttttggtagagatggggtttcctcatgttgtccaggctggtctccaactcctgagctcaagtaatccacctgcttcggcttcccaaagtgctgggattgcaggcgtaagccactgtgctcggcttccttctctttatgtctg

SEQ ID NO: 106076 - DNA, 363 bp, Homo sapiens
ttttgtagggacctggggtctcactatgttgcccaggctggtctcaaacttctgggctcaagcaatccaccctccttggccaggagtttttgccaagtccatgtcctccctccctctgtgtcgggagcaggcctgggcactcagcgtggggatccaggggttcacaggctgcctttgtgtgagagaagctgctatctctgctcatgggttgcccaggggtgcagagtctgcaggaaggttgcgatggagctgggcttttccctccgttcccagcctgcagcgtcatgagttgcctcctgtgctggggtgcagcctgcggttgctttagttctgtgtgggcgagagcttgtgggccccggcgta

SEQ ID NO: 106077 - DNA, 424 bp, Homo sapiens
cacatggggtataaacgtttaaattatgccaaaaactaattaaaacagatatgttgtagatgtaattgaatgcaaccatattacccatttgagaggactggttttaaggtcggtctcactctttaatgcttttctacagctctaagatgtaagtggatgtctcccctacccaattcagagaagccctgaaaccgaagccaaaagatgcactgagaagtcattgtattatatgacttatcttctttaaaagccctggctatttgacatttgatgaaatgccaaatcccaagtgcctgagtccactctgacacattctgtttattatgtagtagtttcaagttggggacccaatttgcaactaactccacaagttatatattacataatgggtatgttctgataaatcacaggaaaaacatgtcag

SEQ ID NO: 106078 - DNA, 218 bp, Homo sapiens
tttattaataagggatagggcaatagccctccttccctttcgagaataaaagagtacaaaaaaatgtacacattagtgaaaacttttttttttaaacagagtttcaatcttgttgcccaggctggagtgcaatggcgcaatctcagttcgctgcaacatccgcctcccgagttcaagtgattttcctgtctcagcctctcaagtagctaggattacag

SEQ ID NO: 106079 - DNA, 497 bp, Homo sapiens
tggatgggttctccctctccagttgttcccaggttgtctttaatgtctttccacaaagttttgtaattattcatgtttaggtcttatacatatttcgttaggtttattttgtatctttatacaggatgctttgtagtactcactggtatcataattggtgtctttaaaaaaatcttttaaatggattatttctgatgtttagatatatggtaaacttttgtatttggtcaccctgataaactcttatttcaaatattttgtagattcttgtatttggatgatggcaaacaatgatagctttatttcttcccttccagttttttttcctgccatcttgtgctggctagggcctttagtacaatgttatagagaagtgctcatagttgatatttttgtcttgttactgattttaaaaagaatgtttttgatatttccctatttaggatgatcttcactctggaatctcagatgcacttgatttggataccctttttaac

SEQ ID NO: 106080 - DNA, 500 bp, Homo sapiens
accatatacaaagcaaataaagtatctattcaaagctctacctcatctttgtcagcttgtgtccagcattggaaattcaagtattgtatttgaatgtaatgatttaagtgaattgtaccatgttggggtttggagtatctcttagtatgacattgaggtggaagtagctgaatctgaacttggtgtttttgagcctgctgtcctatatttgctctcagaattcatgttaaccaaacattactccttgttctttttaatcctctggttcgtaatcaaattgtttcttagcttctgaaagtcttgttaaatcatttaaggtctatgtgacgatagatggtcgttagagaaaagtcaaaaccagattcttggctgtgtccccactcgtgccataggttgtgttctagtgtgaaaacttactgtttcactttcttgggaaagatggggacagatttagtggcaacagaacaagactccgtctcaaaaactaaactaaaataaac

SEQ ID NO: 106081 - DNA, 606 bp, Homo sapiens
gtaaataacctatttctcatcaaacttgaacccctagttttagcattcatttatctatgaatcttgcctgagttgttactgtaatggctattttctagcctttttttgatggggaggatactgtactcaagagcttccccttttcctgttcatttgtcagtatgaactcctggattactttgttcagtgagttattattcattactgtcattattttgcttagatgtttccagatttagctggtttcttttatcaatggtttctttgtcctttgtgacgtttccatcaattcttgagtgctttgcattttccagcacagtaagatgttctggatgcactgtgtcatttccctgcctcagtctggggattgggcatttagtagagtggcttggagtactcactgctgtaggggtatcatgacttctgggccctttcagtgtacagaactaggaaatacacatacagtcacatgtcttataatggtgtttcagtgaacaatggacgacgtatatgatggtggtcctataaaataatggagctgaaaagtttctgtagcctagtgatcttgtaacgtaccgtaacacgttactcctgttgatggtggtg

SEQ ID NO: 106082 - DNA, 402 bp, Homo sapiens
  misc_feature (390)..(390): n is a, c, g, or t
ggtagcccctgagggaaggctgtcatattagccttagttgttctacattggtccagatactatttgattatgtaaagtcgtgaataccttctatccttaatattatgtgcatctgttcatgagcccattgaacaagtatcagctgactaacatctattatataacatgtcattgtatgcatacgattactcctcttcagtggattccctctaataagaatttacttgggctacaagtattttcatacttcgtgtctattttaagaagtcatcttcggctgggcttggtggctcacacctgtaatcccagcactttggaaggccaaggtgggcggatcaggaggtcaggagatcaagaacatcgtggctaatacagtgaaatccagtctcncctaaaaaaaaa

SEQ ID NO: 106083 - DNA, 199 bp, Homo sapiens
tccccgatggagtgggcagtgccccagtgctccgcagctggtgccgtctgtctccagacgctcttccagcctgcattcaacaagccagtcgtatcagaaaatattaaccacgggaattaatgaattttggcattgcagtggagttgactgggggagattttccaagtttattttccaagatgtatctggtgctctagag

SEQ ID NO: 106084 - DNA, 402 bp, Homo sapiens
cgtggctctcaatgggggcgattctgccccacggcagaaatgtggcaatatctagagacatttttgattgtcacgactagtagggtcctgctgggtagaggccaggatcagtgcccaccaccaataattatccagccccacgtctggagagctgagtgagaagccctactagggggccatctcggagctgccgattgcaccaggctccctccacatctctgggcctctgcatctgctatgctttccacctagaacttccttccctccctgattcctgagaccaagcctcacagatgttctctgctctacaacaccttctctgggctgcctcgaggcctgtgtctgcacatccgcctgcatttcctcttctcgcatcaccgccccaacactgtacctggatat

SEQ ID NO: 106085 - DNA, 348 bp, Homo sapiens
ttccaaacagagcccactgcctgttcccggcgccagacttcgaacaggtgaggcaactgtgacgccctgtggctcctttcacccggcagtggggagggtgctcaggccaaggggagagagagagacctctaaacacagcctggagaggaaggctgggcgtgctccgccagcttcacacgcacctctcttggccctgccagatgccatttgtgttttctctttcccgtgccctcgccccttgccaaaagctataggcagcatggccaagattcctctgtggggcaggaaaaagcaaagaaggaggcatgagcttctaattagcaaagatagacaaattgctggtggagg

SEQ ID NO: 106086 - DNA, 340 bp, Homo sapiens
cagaagccaagcactacagggttaaccaagatgatgtcagcaagcccgagcgttaaattgctgagtgaacgctgaaagatctttttagccagggaaacattttgctgtaatggtaccattacaaattttttacagtaataacacagcacattataagcttgctcaactgataagctctttgtaagggttagaagtctacagccctcacacacaaagacctttctgtctcagagttcttagaagtcaataagctaaaaatcacatcctgcacaatatccacttagagtcacagaggatctagtcttctattgctttgcctagtttccccttggcatggaga

SEQ ID NO: 106087 - DNA, 416 bp, Homo sapiens
actcatgttaaagtataattttccaaagaaagcatagctgtcatgcaagtataaaataaaataaacatatgtcaaagacacattaaagagggaaccagtaaggtgtatttataagcttgctaactaagaaataaatattagaaaaggattgctatgttagatgtaaaactggttagtatcccatagagcaataaagtataatttgggggttatctttttcactagacaatggttatttgaatatctattggacagacatctccaaattgtcctgtaattttactaaacctggtacctttaatccaaaattcttacactgagataacatttaaatgggcctttgttcccataagacattgaaaggatatgccatcctttcaataaggccatccacctcttgccttatttcctaagtt

SEQ ID NO: 106088 - DNA, 280 bp, Homo sapiens
tgaaactgtatatctggcagccatattttgatggcgggctgaggcctttaggattgatttactgaatgtcattgtgcatcgacttcctgatataaaccacccaaaaatgcatcatcaacaacttctagttcgtttctttttgtggaagggaaccttagacactcaacagcatccaagaacagcctcctccttgtcctctgcagctcttcccaatcattgtgcagtagtcccactcattcctaatttttcagaaattcttttagtgatttctcttttttaa

SEQ ID NO: 106089 - DNA, 864 bp, Homo sapiens
tctttcctgactatcacaatcctgactatcacaagcttgaaaccaagcttctcactcttctccagttgccaactctaatcctctcaatctcaacagctgttttttgttgttttttttttttgagacagttttcactcttgtcggccaggctggagtgcaatggcgcaatctcggctcactgcaacctccgcctcccaggttcaagtgattctcctgcctcagcctcccaagtagctgggattacaggcatgcgcctccacgcccgtctaattttgtatttttagtagagatggggtttctctatgttggtcaggctggtcttgagctcctgacctcaggtgatccacctgccttgggctccaaaagtgctaggattagaggcgtgagccaccgtgcccggcctcaacagctgtctttacctccaacttcactgggctcaaagcacctcagcatcttcctgtagaattactctccttttccttcattactgtttatgagtaataatcaactctttcttacatcctttttctatttccaatcccttctgcctcctcttggaccttctctttcttgcaaatggcttcccatctttgagggcttcttccttttctaacacaactcctatacacaagaacacctctgatttaatcctgccatatgacctggcataatatgatttatctccaacataggagagacaacggacccttgactgcgagggatcgactagttcaggtttaaattgaaaccgagggctgccattttatggatacaaatttttattaacctccaaaattctgaaatgggtcccgattaaaatatggcgacctcaccccttttatagaacacccgaaaaacttaaaa

SEQ ID NO: 106090 - DNA, 317 bp, Homo sapiens
aaagttttatcacattctgatagataatctagatatctacatacatacttgttgtcccaccaaattgtaaacttcttatggccagggccaccctttgttcaacttggatgccttgtagaacccagcagcattttctacatataattactaaaatatctatgacttaaaatctccttaaagagatttaaatgcatctgccctctcatgtggtaacaaatatgaggaaattattttggttcatcaatttcatatctacccaagatagacatttcaaaatggattaagtgccaaattttatcctgaaaagtttgtaggct

SEQ ID NO: 106091 - DNA, 583 bp, Homo sapiens
ggcagtagctcacacctgtaatcccagtactttgggaggccgaggtgggaggatagcttgagtccaggagttcgagaccagcccaagcaacataggggttacaattagttgtctacactggtgccctcatgttgtcccacatgtattcaagaggctgaagtaggaggatcacttgaacctggaaggttgagggtgcagtgagctatgatcatgccactgcactgcagcctgagtgacagagcaagaccctgtctcaaaataaagaaacaaagaaataaataaaactgctggagaatctttcatgcaacagttacttattgtaaatctactaagtagtagtcagtatccaggaagcagagatgaacggcatgatacttgccttcatggagcttacagtctagtggaaaaggtaccagtaaacaagcacctaccacatgccaggctgtgctacgtgcttatatccattatctattaataatgcatcatcacaactaggctgtatggcataaattattatgactatttcccaggtgagataactaaggctttaaaaggtaagtatattgaccaaaaaaatctgcta

SEQ ID NO: 106092 - DNA, 819 bp, Homo sapiens
tggacagtattgaaattcttattgtaaaacacaatttgaacttttatcttttcagctatagttaattagcataagttgcttaggggatattttgggagaggaaaagaaacaggaaaggccgcctgcagagcacaataatcagaagtactcacatggagatttttagcattaatatttttacaaaggaaagacacatactgtagtgattattgattggccctgggggcagggaagatgggggtgagaaagagaacgagggtcttgagagaattcaagtgtttgaacagctgattaaggagtaaaattaaataatcaagtaagagaaataaatttgtgcagatggctgtgaaagggaaactattgtctttgctgccatgggtcataaattcactctttttctcacaaaagggataattgatgcttcaaacattatggatcaaaagcacagtaatgaatccacagctagcattggaataatattgtcctttttaaaatgtcattgagatcattcctcatagaatggctttcaggacttgaagaaaatctatcccagtggtaaaaaaaaaaaaggatttttgccaaaggtcccagggcaatcacttcttccctgtggattgatttattctttccttttatataatttttattttccttgaaacttacagtttttcagaatatgaaagagttagaaagaaaagagtatactttatgcttttaatgagaaaaaggaaggcagcaccagaaacactgggacaggagccataagaggatgatgtggtttcagtttccagtccttcctaatgtttctcccaaagcatc

SEQ ID NO: 106093 - DNA, 823 bp, Homo sapiens
atagaaacctagattcaccatgagtcatcaagggacttaaagacagacgtatctggagaaaaagagaataaagctgaacatgcagcctccagccccagagaaagactgagagagaacaggagaatagaaccttattagacaccagatgtatttccagcaactgggttccttgaaatttctctggttcataagtgcttcacagacataatgggctagtaaattaggtccttattttggaacaaattgagagatatatttggaagtatgacagagatcaagctgtcagctttaattggagataaaagctaagttggagaagggcatactgctaataattcaccccagatttgtcagatttacctaccccatcacaagcccagtaaaaatcacagtataaaggcaaagataatgcatctctctgcagtcaggccaatttcaaagtctcctccaagatattcttatgtaactactctacttgtcacctggacatcaggactttggaaaacttcccaagtgtttccattgtgcaggctgtcatgagaatatcctctctcgggaagacttactagagaaagaagtagccatcaccaatctttcaagccttttgcactcttacctattggatttgaacaacttatgtaaggtcatcttgggttatgattgtccctctcagtgcttttggaggttatatttgtcacttcttaaactaaaggaaaagactcacttttcttataaagttggaagtagtaaatctgttcctttgaaactagagaaatatgtccctgcctatgaaaacgctgttctacttttgcagaggtagctg

SEQ ID NO: 106094 - DNA, 428 bp, Homo sapiens
agctctggtctctgtcagggatatctctcatcagaatccccatcccagccccagtatagttagtgctctgtgaagtctcaatatatattaaagtttcatgataatgggaatttcatctttgacctattcttagagatgggcagtgataaatacaccgggaatccaacatttccctcacttaaatggagaacgctccaagatttagtcattcctgatgatggcaggaagagacagtaaggttgactatcatttgatgaatctggaagggtagagagacaatcaaaataaccaagatcctaattcctttttacttctttcacacacaaatgtgattttagttaataaaggcaaacagttaattggggggattttccttctcaatttgggaggaaaccctttcccaagtgagacaaatgaccatccttttt

SEQ ID NO: 106095 - DNA, 214 bp, Homo sapiens
gtgattgttgtgaaatggggaggtgtgggttttactgttttgagggagaaggcgatgtgtttgtgttatggaagggaggcagggagagacatggccataatttgatggttttggggagggagtgaagattatttcgatttaaagggggcaggggcagccatgtttgctgccaaggcactgcagtgtaaataaattccttttcctctccgacatc

SEQ ID NO: 106096 - DNA, 315 bp, Homo sapiens
ctcatgagaaagaagtgtcagagacaggtttgcatgatagttgtaaaaacagctgtgcagagaactgtgaggagctggaaggacagtagggacagacaaacagtcagcatagacccaaaggcacagaataggacagggaacaatgtaggctggttttggggtctctttttgaggcagggtctcactgtgtgggcccagctggagtgtagtggcagaatcatggctcaatgcagccttgacctcctgggcttaggtgatcctcctacctcagactcccgagtaactgagaccacaggcatgtgccacgcccagcta

SEQ ID NO: 106097 - DNA, 294 bp, Homo sapiens
ctcatgagaaagaagtgtcagagacaggtttgcatgatagttgtaaaaacagctgtgcagagaactgtgaggagctggaaggacagtagggacagacaaacagtcagcatagacccaaaggcacagaataggacagggaacaatgtaggctggttttggggtctctttttgaggcagggtctcactgtgtgggcccagctggagtgtagtggcagaatcatggttgcagtgagctgagatcgtgccactgcactccagcctgggcaacagagtgagaatccatcttaaaaaaaa

SEQ ID NO: 106098 - DNA, 397 bp, Homo sapiens
ctcttctggtagacagctctggtgccctagtccggagcacatattcctgcatggcagtaattgccggagcttgttggctgctgtcccttccagaattgggggagagagagagagtatctcctctttgtacttgtaaaccttcaacttctctcaaggtctgtgtcaccctagccccagaggtatttaagtttacaaatcctgctctaaattgagtatttaaaccaaactgaggcccttcaccttgcctgaaactgccgtctgtgctttccataatgcaggtagtctgagtccatctcaactagggttcctggggtttgctagattttccaagtcccgggcttgcttcagacctcctagttcaacctctgggatggggcctgggagccggcattttaaa

SEQ ID NO: 106099 - DNA, 300 bp, Homo sapiens
tgaagatggagaaaagggaagaaaagggtgccactattaggaaacacaaaaagtgatggcagacaaccagatagacttcagaacttcactctcctgtccaggaccaggcttcattactattgccaatttgctaacactccagccttacagctcctgagtaactttcacgatctctctagggccccaagaaaattacaattgaagaatttaactaataatggtttctgacaagaagaaatcaaatatgctttcacctactccaaactcagcacatattcagaagcaagatgtatcttataa

SEQ ID NO: 106100 - DNA, 473 bp, Homo sapiens
tctatgcccttccttcctctctacgggactcccttatctaccctggcttccttccttagggtaacccatggcagaggtcactgctccccaagtgggaaaccccactgtgacgtgtgagccagcatttctgagaccagaggagccattctgggggaaggagaggtggctgcccctttagaaaccactctccttgctgcccaagagttttgcctgggggttctcaagcagaaagaggattacctgagagggaaagtgccccggaaaaggccaaggactcatgaatcacagcccacctaaagccccaacctaagctacacggagagacagagaggcagcagggctgcctggacaggtctctgaagattccaggcatgtgtctggtccttggctgcttttcccaacccccgtccccaggtgctgaccttggcagagtgacaaacacttcccatacctgtgctgggctcagacgtgcc

SEQ ID NO: 106101 - DNA, 401 bp, Homo sapiens
tgagacagcatttcactctatcacccagattggagtgcatgccacgatcatagctcactgtagcctcagcgtcccaggctcaagcaatcctcttccctcagccacctgagtagctggaactacaggcgtgcaccaccaagtccggctaattatttatttatcattattttttgtagagacaaggtctagctatgttgcccaggctggtctcaaactcctgggctcaagtgatcctgctgccttggcctcccaaattgttgagattacaggcttgagtcactgcacttggccggttttctcatctttagtaagaattgtgatccccaaagctgtttaggtatgttgttaaccagcattgtctagggatggtgaatgtgggctacctaggttaaaattccagc

SEQ ID NO: 106102 - DNA, 732 bp, Homo sapiens
tagagaagaataaattcagattctgagatttccagctactgcatccatggttgcttttttaaattttttttctggttagttttgatttttaaactctgtcttacagaacctgctagatgagatagcaagtagggagcaggaagtacagaagatctgtgccaattcccagcagtaccagcaagctgtaaaggtgagccgggaaacttccgcccaaagcacaaacagcaggggtcttattccaccgtgccctggtcagagaagcagcaagcaccggccctggcacatgggggtggagctggccatccgaggcactgccggctgctgtgcaaactggcacaggcttttgggaaaacagcatggtactagacatggaatgctgtaaaagggttttatactctgaagcagtaaactctttgggggaatttatccttaaggaaaaagtacaaaaaaaaaaaatgcaggataaacaacattgttgcaacagcactatttacaatagcaaaactagtacgctggaaaggactggtgtccagtggaaggggaaagctgcgtgaatcagcacacatccacctgatggattataaagtcagcaagctggtaaacatgagaagaggtggtggcaaggtgagacagggttatggtacgatgttaaaagcagcagcagaatgtgaaaatctctaggcatgtagaaaggctgggaggggaattcagggggcacttcttgtctcatat

SEQ ID NO: 106103 - DNA, 1045 bp, Homo sapiens
tcccttcctaagctgctgggagtcgtcacacccccacccgtgactgggtggagtcgtagtactcacctcccggggttgccgcaaagattaaacagaagcgtccgcgtgcagtgctgaggacagcacaggcccggcagctgcctgggtgcttctggtgtcactagtccattccacctcagcggttccctgggatgctcgtgaaaaatacagccctcaggctggggtccagatgccgggtcagagccccagaatgtgccaggcctctccagctgcttccactgtgcctgatgtgggaatctgtgctcaccctgggcacatcctcaggggaaggggctgcctggctgtgtccaaaactgaggggccctggttcccacagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggtgagtctagggcccaagtcctgggagtccttctctgagcaggtgagagcatctggcacatccacccgcccgtctggatagatgaggacaccagcatccagtctccccaggtttggaatgcccaaattgggaactgcaaatggaggcccgcagcacaaatccaagctattcacgggatctgtgtgacttacgggatttcgggtgccagcattttaagatcaaatatctgcaatagccagtgtagtggcacatgcctgtaacaccagccattcaggaggctggggcaggattgcttgagccttggagtttaagtccagccgcctggacaacgttgcaagaccctatctctta

SEQ ID NO: 106104 - DNA, 6229 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagagggaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcattggtatttaggtatacaaaacagttgattattcaccacgccaatatctgggtctctgtatctcatgtagaacataagaaaatgggaactaatagggaactttatttatagcatgaaaataaacctggtggctggagtctgct

SEQ ID NO: 106105 - DNA, 4865 bp, Homo sapiens
tcccttcctaagctgctgggagtcgtcacacccccacccgtgactgggtggagtcgtagtactcacctcccggggttgccgcaaagattaaacagaagcgtccgcgtgcagtgctgaggacagcacaggcccggcagctgcctgggtgcttctggtgtcactagtccattccacctcagcggttccctgggatgctcgtgaaaaatacagccctcaggctggggtccagatgccgggtcagagccccagaatgtgccaggcctctccagctgcttccactgtgcctgatgtgggaatctgtgctcaccctgggcacatcctcaggggaaggggctgcctggctgtgtccaaaactgaggggccctggttcccacagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagagggaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcattggtatttaggtatacaaaacagttgattattcaccacgccaatatctgggtctctgtatctcatgtagaacataagaaaatgggaactaatagggaactttatttatagcatgaaaataaacctggtggctggagtctgct

SEQ ID NO: 106106 - DNA, 5824 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagtggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcattggtatttaggtatacaaaacagttgattattcaccacgccaatatctgggtctctgtatctcatgtagaacataagaaaatgggaactaatagggaactttatttatagcatgaaaataaacctggtggctggagtctgct

SEQ ID NO: 106107 - DNA, 5591 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagagggaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacagcagctcgcacccatgagttggggatcctgctagtagtcgaccggcaacctgcg

SEQ ID NO: 106108 - DNA, 2409 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggtgagtctagggcccaagtcctgggagtccttctctgagcaggtgagagcatctggcacatccacccgcccgtctggatagatgaggacaccagcatccagtctccccaggtttggaatgcccaaattgggaactgcaaatggaggcccgcagcacaaatccaagctattcacgggatctgtgtgacttacgggatttcgggtgccagcattttaagatcaaatatctgcaatagccagtgtagtggcacatgcctgtaacaccagccattcaggaggctggggcaggattgcttgagccttggagtttaagtccagccgcctggacaacgttgcaagaccctatctctta

SEQ ID NO: 106109 - DNA, 116 bp, Homo sapiens
cgccaagttcactgaagtttatgccatcaacagacagaggctgcagaatctggagtttgctctgaatctcctcagacaggtaactgatcttagtaagaaattctacttcaggctgt

SEQ ID NO: 106110 - DNA, 6337 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagagggaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccctgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcattggtatttaggtatacaaaacagttgattattcaccacgccaatatctgggtctctgtatctcatgtagaacataagaaaatgggaactaatagggaactttatttatagcatgaaaataaacctggtggctggagtctgcttgtacggtccacatgtttcttcttttgcatgcaaggcttactcccccgccccccccccttggctttcagccaaaatggatattccatctgtaacagctcctacaggaa

SEQ ID NO: 106111 - DNA, 5075 bp, Homo sapiens
  misc_feature (4989)..(4989): n is a, c, g, or t
  misc_feature (5024)..(5024): n is a, c, g, or t
  misc_feature (5036)..(5036): n is a, c, g, or t
  misc_feature (5051)..(5051): n is a, c, g, or t
  misc_feature (5061)..(5061): n is a, c, g, or t
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtggtcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctgcgggccgaggcgagcgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagagggaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatnctgtttcatggatagtcgaacgttcgggtaatccntatgactagttnatcctcttaaattcnaccttgccangggggggggggggg

SEQ ID NO: 106112 - DNA, 448 bp, Homo sapiens
attctcatgtttataatggagactgaccagcaagattttgctgtgcgatgagttatctttgacgctttgacgtttattcaaatacagtcactctaataacaaaggatacggttggcagccataaaaaatgatgagttcatatcctttgtagggacatggatgaaattggaaaccatcattctcagtaaactatcgcaagaacaaaaaaccaaacaccacatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtat

SEQ ID NO: 106113 - DNA, 205 bp, Homo sapiens
taagaagagttaatagattattgttttaatcagttgtaggtttacaggaacatgaatggcaagtacagagtttccacattactcccctacactcacattttcttttttattaacatcttttattagtgtacttttgttgcagttgatgagccaaatggatacattattattaactaaagttcatagtttacataagtattcactc

SEQ ID NO: 106114 - DNA, 184 bp, Homo sapiens
ttagtgtcattcttgactgaagagccctggacaaaggtatggcttttgataaagccaaaatattagcttgttttgttattcaaagggaatgtgctctgggagatttctggtctacacccagggacagtgcctggcatattgtaacagcttagcacatacccattgtattgaactgaattaatgg

SEQ ID NO: 106115 - DNA, 150 bp, Homo sapiens
gagatggcgccgactgcactccagcgtgggcaacagcgtgagactctgtctcaaaaaaaatagagaagaagaaatcaggaaattgtgaggcttcataggaaattctcaaaatcagtaatacccaaaagatataaaagtggttttggtgtt

SEQ ID NO: 106116 - DNA, 560 bp, Homo sapiens
actgccaccacaacctccccagactcaggtgatcctccctcctcagcctccttagtagctgggactacaggcatgtgccaccatgcctagctaatttttgtaaggactgggtctccttatgttgcctaggctaggaattctttatcttattccaggactttgaggagaggtctgtaaactgaaatttgacagtatttttttagaaagtattttttaaatgtattttcctattaatttgaaaattaaatatttaaaacttttttttttttttaaacaaagatgagatctcactatattgcctaggctggcctcaaactcctgagttccactgatcctcctgccttggcctcccaaagtgctaggattacaagcatgagccaccgtacccggccaaaacattttttttaagtcaaaattgcttaggaatttgtttcccatctcttactttaaataagtataggttgcttattttggcagcactaaaattggaatgatacagagattagcatggcccctgtgcaaagatgacatgcaaatttgtgaagagttccatatttaaa

SEQ ID NO: 106117 - DNA, 324 bp, Homo sapiens
ctgcagagggtcgtctaggctttgtttatctccagagattaggagtcttttatttcttatttttatttattgagacaatctcatgctgtcacccaggctgaagagcagtggtttgatcacagctcattacagcctcaaactcctgggctcaagccatcctcccacctcagcttcccaagtagctgggactacaggcgtgcgccaccgtgcctggctaattaaaaaaaaaaaaaatttttttttttttttttaagagatggtgtctcactttgttgcccaggctggtctcaaactcctcctgcctcagcttcccaaagtgttggg

SEQ ID NO: 106118 - DNA, 423 bp, Homo sapiens
tttacggatgagcaacctgatgtcacaccgctaatacgtagaaaaaggacttagtgccgcctaaccactacatttcctaatgcaaggctgccgggtttagttacagacgttatcgcaaaatgaggtgccaggactgagacccagttgctgtttttccagacaaatcaaatgagccctctttagattgccaggccccgctttgataagagagagccatcttcaagtattttagtttctctcatgcagttccctctactgattgcccctgatcagaaatacagagacagtcatagtcagcctacgcatattcacataacagtctcaccctgctttgtcttccgcctctcctccctcacatgaaaccccgtaggtttcattttgggttgcagtgacatagtaaacagctgtcaactggattttcgc

SEQ ID NO: 106119 - DNA, 207 bp, Homo sapiens
gagatcgcgccactgcactccagcctgggagacagcaagactccgtctcaaaaagaaaaaaagaaaatatatttacaaaactggtactattgtagagctcttgcatttaggggaaagatttaaacttggttatagaagaattggtttctcaaaagccatatttaatgcttttattttgtgtgactttttagggattctaatacttat

SEQ ID NO: 106120 - DNA, 549 bp, Homo sapiens
gttaaatgattttcaggggaggcatcaaagcaattcaatggggaattgcttttcaacaaatagtgctggatcagttggatatccaatacagaacaatgatgaacttcaaccccatctcacaccatgaataaaaaataatttgagattgatcatagatctgaacctaaagccaaaactataaaacttctagaaataaatacagcatatctttgcacagagtgtaggcaagatgcaagaaaagcatttgatgaaattcaacctaaggaagatgcaagaagtaccaccccctcatggtgttagaataacactggtagaatcaatatgaaatcatattgttaatagttgttaatatatgtgtgtatacatagatgttgctagggtatgaacgtgtccccaaaattctcatgttgaaacttaatcacgccctggtgtcctggctcaagcctgtaatcctagcactctgggaggccaaggcaggagaattgtttgagctcaggaatacaaaactagcctggacaacacagtgaggcttcatctctactacaaata

SEQ ID NO: 106121 - DNA, 424 bp, Homo sapiens
gggtcatgggagtggatttctcatgaataggctaatgtcctcccttaggggtgagtgagttctcactctcaagggaaaggatattccatgaagagtgggttgttaaaaatagtctgagtctgacttcgttgattttgctctcttgcgtcctctcttaccaagtgatctctttgcacatgccagctccccttccactttcaactcccccgccatgagttgaaccagtctgagtccctcaccagatgcatatgccaaatcttgaactttctagacaccagaattataagccaaattgcttctttataaactactcagtctcaggtgttctgttatagcaacacaaaatggataaagacagaaaactggtaccaagagtggggtgttgctataaagatacctgaaaatgtggaagtggcttttggaa

SEQ ID NO: 106122 - DNA, 635 bp, Homo sapiens
taaatgtcctatgctttttttcccccgtctacttaatatgttccacagtggactgtgttttcaggatggtcttgcgagcaaagcgaactacaaacgttgctattatttcgttttgaaaatgatatttttggtggcaaacgtgataggagaggtcatctcctaaaaagttctaactcaaaagtgtgcaaactggataaaattcaccaaccaatagaagagtggccttgcctttcctgaggagagtcatccagtctcacactcgggcagtgggggctactttaatctcaaatacaccacgatccagctgtgtgatgggggcgggttccccttcccagccttgttttcctccctacagcctgtcagtaactccactttccatcagaagcgttaccatcagctcaaacgtaaccattgtgtagtgtcccactgtacacagcagtgacacccccactaccccacctctcccagggacaaacatcacaaagaaaagttagaacatttttgccatcagacttcttgccccaccacagcaaaattaccaaagagtagaacaaagcttcagagacccaaaaacctttgcaacttcctactgctcactcacagtgacaggattagtttattgcttaccactttcc

SEQ ID NO: 106123 - DNA, 241 bp, Homo sapiens
ctcagcgtatttctgtcacgttctaatccccagaccaaaattagaagccatcaaagcatacgctaatacaggcaggaggacagaggctgatgctaacactgcatgaatgtatggataattttgtcatttttacatatgagtgattaggaatcccttttacttttcagtgtcttctgagaaaccaccaggcttgaaggctacaagtgatgagaaagattctgttttgaatatagccagagga

SEQ ID NO: 106124 - DNA, 311 bp, Homo sapiens
aaagggtaggactctagaacatttaggtcatggctttggaatcagagctctcagcagtttcatgctttgtggataattaaaatcaatacaaaataattacagaactagaaggatctccagatacctaatccagtcccttgtctccaggagaaactagatctagtttaaactaacttccacacagatacttgagttgtatgagagaaactgggactctagattcactttctgcacttaccaagaatattgcaaatgtggcttggtaaccagtgttcaaaaagagattatggtttttataagcatgacattgg

SEQ ID NO: 106125 - DNA, 340 bp, Homo sapiens
actacctgcctcacccattactttcatgttcctggaatttttgatatgaagaacaatgtatagcctatcagtagcttatgtgattttaatataaaatacttggtaagcaacttaggaactgcttcttctttttctttagaaacctacttgtaactgtagctaatcagagcatatattcagggcaacttaaatctatgttcacaagttgcagtcttcaaacttggtccaaataaaatctctacttacgttaagttggcctcaattttttcctttaggttgacattcctttgatcttttaatatgttgaatttttaaatttcttcattgaatccttgatcat

SEQ ID NO: 106126 - DNA, 319 bp, Homo sapiens
caaatgggccacctgcttccgttgatccaccatctacccaacaaaaaggtcaatcaaatcaggaaccacccagcttagccacccccaaagacttaaaaaagcacttaaggccctccatgaccaaacacctgttcatctggaccctggacgttcactcctttccagccacacgaatcttttgacactctgaacacaccaaaagttttgcagcctcagggccttcacacatgctattatctttacctaggatatcccttccctaaactgttttgaaagaaatttaaagaacaggctggacgccgtggctcacgcctgtaat

SEQ ID NO: 106127 - DNA, 173 bp, Homo sapiens
agcagtggaaggagagcgagaaggagaggccaggcatgcagcagggactgacgtaagcatgccagaccctggacagcccaggcaccacttgcggccagatgttaagagaaactcctgaacaaagtgtgactgccaccatccagcccataaactccctctctgtggccacaaag

SEQ ID NO: 106128 - DNA, 636 bp, Homo sapiens
tcatgcagattgttgaggcatatatagttttgcttgaatttcatagattgctttagttatacaatttgatcaggatttttctgttaaggataagtttttagtgggtacttgtcttcccagtgtggaaggggtaaagcaagacacataatatccattcatgtgcatcagagaagtcactcttacctagtagaggaagaattttttcagatgccttgcacattcaaagctatgtctaactcagccatggttcagcgttggttaaaatggtgtacataatatgatgatatacaggtagcttacccttcttctagagtgtacaggatatcagtaagatcttttgatttgaaaatagaaatgattcattttcatattggtatcaacattttaatttattttaattctaagctatggaaaagcacttcatctagtctgtttgaattaagttagctagggttcaatttttcttttctccctgcttttggttgtattcgcaaggaatgataggaagtggggatgagagattaatcatggttttgaggttgcttttggttattctgtatatcattcttacgtgcttctgagatgtcctcacgtttataaatatgtgtatcatataaatgtttgtttcatgtttta

SEQ ID NO: 106129 - DNA, 334 bp, Homo sapiens
tggatatataaccagcaatggaattgctgagctgaatggtagtcctattttaagttctttgagaaatcttcaaactactttccacaggggttcaattaatttacatttgcatcaacagtgtataagtgttcccttttctctgcagccttgccagcatctgttgttggttgactttttagtaatagccattctgacgggtgtgagatggtatctcattgtggttttcatttacatttctctggtgattagtgatgtggagcactgttcatgtttgttggctgcttttcatggtttgttggctctttgttgagaagtatctgttcatgtcttttgc

SEQ ID NO: 106130 - DNA, 381 bp, Homo sapiens
ctcagggtggggaagggtgagagaggggtgagaaattcttatttcgagtacatattgggtacagtgtacattgcttgggtgatgggtggaccaaaatcctagaaatcacctctaaagaacttattcatgtaaccagaagccatctgtaccccaaaaacttgaaataaaaacacaaacttagactgccaaaatataagtttgattctcactttgaatctcaaaaatctagttttacaaattaacaaggaacacattaatacttaaagaagaaaaaataacagttaagaaggatttcatacagtcattaattaaaattattaggccaggcatggtggctcacacctataatcgcagcactttgggaggccgaggcaggcagat

SEQ ID NO: 106131 - DNA, 649 bp, Homo sapiens
tacccaaggtctcatagcaaggcagaggtggaaaccgttttcaactccaggtctgtctggccccagtgtctcatgcagttttcattaccttgagctcacccttagtgacaatgtcattcatttttattctcaaccgcatcttccaggcattgcttgcctcgggattgttttaaaaaaattgctgaatacagtgaagaaacgtattggaagacatcttccaaggaaaaaccctaaatactgatgctttattggaaacaatgacttaagtgataggaccaggattagaatgcaggtgtgtcgtatctgactccgaagcctatgtcattttcactgcatgtgttagtacataatattaaatcctcttttgttttttcttctctgtagtgatgctgaaaattgactaggattgggcaagatttttttttttgaggcggagtctcactttgttgcccaggctggagtgcagtggcacgatcttggctcattgcaacctccaccttccggattcaagcaatcgatccttgtacctcagcctcccaacttgctgggattacaggaatccaccagcatgccgggctaatttttgtatttttagtagagacggggtttcgccatgttggccaggctggtctcaaactcctgacctcag

SEQ ID NO: 106132 - DNA, 241 bp, Homo sapiens
gagggctgaactgggacgaccagagagtggaagctcatacaattctctgggaagaagttctgctaacaacatgtctgatcatgacatgggccttctggacctattctgttggggacacagtggaagggatgaccttgacagaatcttccaaccctaagattctgggattctaggccaaaacctgggtcttgttttgaagtagaaatgatatccagaagtcgacaggctacagtggcaggta

SEQ ID NO: 106133 - DNA, 811 bp, Homo sapiens
attcacagttgtgagtgattctgggaccagtcagcatggatatctcaatgttgattattgtatttagcaaagaaaatggtactatattaaagtagcagttcccaacctctgtggcaccagggacccccagtttcatggaagacaatttttccatggcctgcgaggtggaggggatggtttcaagatgaaactctcccacctcagatcatcaggcattagttagattatcataaggaatactcaacctagagccctcacatgcacagttcacaataggtttcacgttcctatgagaatctaatgctgctgctgctctgacaggaggcagagctcaggtgctaatgctcgcggcatgctcacctcctgctgtgcggcccagttcctaatggtctgcagcctgggggttggggactcctgtattaaagaattttaaaaatgtaaatcactgtcatatagatttgtctgtattctttggattccattataggacaactcttgagataatacttgtttgaatttgtgaaaggtttcttatatagaagaaaattaccctaaattttatcctgtatcattttaggaaataattagaacccaattatttttatgtggcattagatcaaatgtttttcctaatttatctcactaataagattataatgtcagccagttatacatatgagaacacttagaataacataacttgatttttggacaattcgctattctgatgtttcaatgaacagtttaacatttgaagttaactgttgtaatagattaactaccaagcaaattagcactgcacttgcttgat

SEQ ID NO: 106134 - DNA, 358 bp, Homo sapiens
ttttcaagtataaagaagagtgtagtacattatacaggtgagatttttaatttggggaaaggatggattagttagtaagtgatattggagaaaagttacatttctgctccatactatacatcaaaataaattctagataatttaaaatttgctattaatattaaatgaaactataaagtactagaaggaaatgtgagtgaattattttatatttcaagaggacttcctaagtatgacataaaaagttagaaactatagttaccaatatgacaagaatgttcaagaaactggtaggacttaactacatctgcatgaacaccttttgaatgtgaacaatcattaaaaacaaaattgagag

SEQ ID NO: 106135 - DNA, 274 bp, Homo sapiens
gtgtgcctgcgcacagagaccccaagcgttctggagctcctggagagaaggccaaggaaggctgtgcttgtttccaccaagtccaggggtggcgttcacagcccgtaatacattaaggcaaagcagcgatgtctgagccttctgcggttctgaaactgctgctgtgatgagattttctacctgtcctctctcaaaacacagtgatcccatacactgtgtgtttagaacttcagaagaattagtcctccctctgtccaacaatctacaggcatca

SEQ ID NO: 106136 - DNA, 862 bp, Homo sapiens
cacaagattcacatatactcttcacccagattcaccgatggttaatattttgctacatttgttttatcatatttttctgagttatttgaaagtcagccacataatatataatatccctttataattatatacagtatataatataaacattttagtgtatatttccttaaaaaaacaaactaaactaataaaaaacaaagtatagatgtcacaatcaggatattaactttgatataaactgttatctaatctgtttattcagattttactaattgtcccagtcgtgcccgttgtagcaaaagaaaaacattttccttcggttcaggatttaatctgggatcaaacattgtgtttagttgtcatgtcttttaaatctcttttaatctggaacagctccttaatcttacattgtctttcatgaccttgacatttttagtttacaggccagttctactttataggatgttccttaatttgagtgattttgatgttccctgtgcttagatttaaggtatgtgtttttgactgggatactgcaatggtgtgtctttctaggtgcatcataacaagaggtcctgatgcctacttgtcccatcactgataaccaacctaaatcatctagttaactggtatctgccaggcttctccactgttaagttactatttttcactttgtaattagtaagtattttgtagggtgatactttgtatataaatcctcttccttatcaaactttcatttactaatgctagtgtccatccttctgaagcaacaaagtgagacatgcaaagtgaatagactctaccccttggagctaaaatgaagccaagagaaagtgaaccattcagtccgtttaggcag

SEQ ID NO: 106137 - DNA, 1075 bp, Homo sapiens
cttccctgtaaatgcttccaagatatgagcgaatgctatagaaattgcaggaaagtccaaagggctgcgcgtctcctgtggctcagtcttatttcatacctgcaacatcttttaagggaaatttgcaaaagggagaattatcaacttaaaaaaaaaatagccaaggaaacctcgactcttcaaggaagcaaggaaacgtgctctccttgggagtgacattagaggaggcccagtgtgagtcaggacttcatcaccacctggcggaaccagggagccccaccccatgtgtcagtggagatcatgtgctgtcttccctctccaagctagggtttgtcagcagaggcccaggagggagactgaatctcgcctgacagcaatgaactgataccttccttccctataagcaggtgacagacaatatttaataaaatcaaaaaaggctgggtgcaatggcttacacctgtaatcccaacactttgggaggccaaggtgggtggatcacttgaggccaggagtttgagaccagccccagcaacatggtgagaccctgtctttactaaaaatacaaaaaaataaattagccaggcgtggtggcacacgcctgtaatcacagctactctggtggctgaggcatgagaatcagttgaacctgggaggcagagattgcagtgcactgagatcacacaattgcactccagcctgggcaatagagacagactctgtctcaaaaataaaataggcttaaataagattcaggatcttaaagtacccagaatgcccagaatacaataaaaatcaatcactataccaagaaccacaaaactctcaacttgaatgagaaaagagagtcaacagacaccagcatcaggatgacacagatgttggaattaagatatagagaagaatgaaacagatgtcttagaaccgaaatatacaatagtcaaaataggaaactgaatggatgactccacagcaaaatggaggagacagaagagagaatccatgaacttgaagttagagcagtagaaatcacctaacctaaacaacagaaaatagactgaaaaccaaaacaaaa

SEQ ID NO: 106138 - DNA, 165 bp, Homo sapiens
tttagatttctgaagcagctaaatggaatgtctaaattccaaccttttccttctacaaattgttttgccacaaagttactgggagaaagtgctgtggttttatttatttgaagaagtatattaatccacagaagactctgcatgcctaactgggctttttgtata

SEQ ID NO: 106139 - DNA, 479 bp, Homo sapiens
gaacaatgaagaatctcaattatatcaggaatttgtacattagatgtgtcgttttaaaatcctatgcctgattatgcatacacaaataacaagtataaatcatcctcttcatacacattttttgtttaatctttaatacaaacccatgggaaagatttatcctactatcacaaatgatgaatctaatgttcagatattaggaagcataattttgctatttgtcttcctcattaaattgtgaattcctgggaggaagtgtgtaatagtagaaccaacttacttatgctgaattcactgtcccataaaaactgtgtgtcgcctgaacaagttattaaccctcctgaatctcagtttctttacctataaattgcaattacatgaagtacatataaagtcgttaagggcctgatatgtattagctaagtaatgagtgtttcttacaccatcatacatagcagagtccatgaatagactctctg

SEQ ID NO: 106140 - DNA, 151 bp, Homo sapiens
gtacatacaatttcatattcggttatttttcagttaatattgtgaggaagccagagatcacttccaaccccacttttagctcttagtgggctttttagctggatgtagaggccaaattgagagcaggcagattaacaagagaaaagcgtac

SEQ ID NO: 106141 - DNA, 1733 bp, Homo sapiens
ctggggcctgtggctccttctccatgttggccttcccttgtgtctcttgtccctgtaggagtgccttatagtactgtctcgtgcttctagtctagtctgaaccacttgaagcctgcaggacccttcaactaaatctggatccctttgcttcttccctgctggctactcttcatatagatgctcttggagcctgtgcattccatgatgcatgtcagaactctcaccttgttcagcctggtgtgccttaacctcaggagtaaagggaatcatgtcggaaacacgtcgttaaagtagaatggtacaaacattggcttcttagtgccattagcacttttaccaggaaatgcaaaagatgcaaccacataatgttttcactttgttttatgctgttcttcaatcgctctttttgtttatttgtttgtttgctttcattaaccaaactcaggggaatgtcatgatgtcaccaaggccaatgggtagagaaataaaaaccagccatccataattgaatctgtaaagtcagtgaacttagccttttcaggttcaaaattacacaaacacaaggattttcttatctttcacctttcaaaggttttctttttattttgccacctgttttccaaataagaagtgggaagcctcttagataaattgtgataaaaatgtctctttgtttggcgtgagctatcaaattagctttgtgtgtccactgagccatcaaattaggctttggctgctggaggcctaggttctagctttggtcacctatcagaatcttactgttacgctgggcatggtggcatgtgcctacagtcccagctatttgggaggctgaagtgggtagattgcttgagcccaggagcctgtgcaatatggtgagacccatctcaaaaaacaaacaaaaaaagaagtagaatcttactgtgaatagtactagctaccctagaagatatatattttaaatctgtttcttaggaatagtagctaaaagaaggaatggccaaaggagggaaagtggttggccgcagcggctcacacctgtaatcccagctctttgggaggctggggtgggaggatcactggagcccaggagttcaagacaagtctgggcaagatagcgagaccctcatctctttgaaaaatatatatatatacttttttttttaaaggagagaaaatgcttaggttgcaaatggagagtattgaacgtggtgatgtaaaaaacttctgcaaaacttgttctgtagctcctgggtcaggtctatgccattttttcttatatctgctcacacagtacagaaatgactaaaattttgggtctgggctgttatatcactttgtgttaagttatttgtagtagctaatgtgctaacttatatatgtgttctttctgttttttggattttaccttttgttttggcataacttatctatatttttgtttacattattttaaaaatatcagtaactgtaataatataaaattgaagttgtattgttgacaatacctctagtttttaaggtcatctgtcacataatttaagtgcaccagttcctaatgtataaagttctctctctctctctctcaataaacaatgcagaaaatactttcctttctcataacaacttgattaaaatactgctcttgagggggtggtgaaagcccaaggtgagccctatatattaattcaaagtcaagatttgagctttattgaaaatgagccacagccagg

SEQ ID NO: 106142 - DNA, 886 bp, Homo sapiens
gcggccgtctactactactaaattcgcggccgcgtccatctcaaaaaacaaacaaaaaaagaagtagaatcttactgtgaatagtactagctaccctagaagatatatattttaaatctgtttcttaggaatagtagctaaaagaaggaatggccaaaggagggaaagtggttggccgcagcggctcacacctgtaatcccagctctttgggaggctggggtgggaggatcactggagcccaggagttcaagacaagtctgggcaagatagcgagaccctcatctctttgaaaaatatatatatatacttttttttttaaaggagagaaaatgcttaggttgcaaatggagagtattgaacgtggtgatgtaaaaaacttctgcaaaacttgttctgtagctcctgggtcaggtctatgccattttttcttatatctgctcacacagtacagaaatgactaaaattttgggtctgggctgttatatcactttgtgttaagttatttgtagtagctaatgtgctaacttatatatgtgttctttctgttttttggattttaccttttgttttggcataacttatctatatttttgtttacattattttaaaaatatcagtaactgtaataatataaaattgaagttgtattgttgacaatacctctagtttttaaggtcatctgtcacataatttaagtgcaccagttcctaatgtataaagttctctctctctctctctcaataaacaatgcagaaaatactttcctttctcataacaacttgattaaaatactgctcttgagggggtggtgaaagcccaaggtgagccctatatattaattcaaagtcaagatttgagctttattgaaaatgagccacagccagg

SEQ ID NO: 106143 - DNA, 290 bp, Homo sapiens
caggggcccagctgggatgtggcagcagctgtctgtccttcggcactgccccaaccaccctgtgttcttggtgggatggagaggtgctctaaaggtggaaacagttgtgtacggtggataaagaggtcttggggaactagtaaaatgtccctattccctgggtcattgtagggggccccacccacctgaaccaccgtagactccaggatgcatccagaagtgttctgtccccagcatgcttctgggggacccacacaataatgatattcatggaggaacacgctgggaca

SEQ ID NO: 106144 - DNA, 4723 bp, Homo sapiens
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 106145 - DNA, 4676 bp, Homo sapiens
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggaggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 106146 - DNA, 1021 bp, Homo sapiens
ccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtggtgagttgtataattatttcattctatatgacagtgtaataataatagaaacaaagtgcacaataaatgtgatgagcttgaatcatcccagaaccatccccttgcctcacctggtctgtggaaaagttgtcttccatgaaatcggtccctggtcctaaaaaggttggggaccactgctctagagcacatcccatggcacccacgcagggtggtttattgagagcacagaaggagggaggagcatgagatctcaggccatcagtagacactgtgaaggaaagaccttgagaaggaaaacagaaggcgaggggccggctttcctgcccggctcactctcgtcaccggggctcaagggaacgaagcgcacctgctctggcctcacgggtgcggtaggggaagccaagaccaccctggctgggggcagagatgggagctcagggctctgaagcccagggagaggctgctgtgcagggcggggtttcaagactcccagagaggctgcttgtgggaagcacgtgaaaggctccttaatccaagagtgtctctgttgacgacatagtgccacctgctaagtctctgtcttgccaacatgagctgcagtcaagttgtattgcattaggtcattgaaacctcccaagtgcataggaccccgcctaccttta

SEQ ID NO: 106147 - DNA, 5866 bp, Homo sapiens
ttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagtaaaaaaaaaaaaaaaaaaaaaaaaaaaaaaaaaaaaaaaaaaaaaaaaaaaaaagaggggggagcgcgcgccacaaaaaatcccccacgagggggcccacagacacccgcccaacccgctatttttgtcgcaacgggggcgcccaccacaaaagagaggagagccactctcatctcaacaccacgacagagcgcagcggcgcgcggcgaggttttcccaacgacccaccacacgcgggacaacaaaccgcgcctcccccgggcacccctcagggacgagacacgcccccccctcctcgccggagacggcaccacaccccgcagcggcccccaacccccgccccccagccgaacgactacacacaacccccccaaaggcgacaccacaacaccacacccacaccagagcagcaacaagacgccggcaaccaccaacgcccgccaaaacacgcgcccacacctacacaaacctcttgctcccacacaccagtcgcactgtactattcctcatacaaacccacatttcttacaccgcgagcacgcaacactcagtaaaaaaaaaagcaaaagccaataccgcagccacaacacacacacgacacctatcagaccaaacgtatacacaagcacacagcacaactatttacgacaaactatctcatcacaacgtccacatatcaatatacatctgaatctctcaaatcttcctcattacttgcacactcatcctcacaaacacaaccaccaaacaaacatacgacagcccatacacactcgacccatcctaccacacacaacgaactatacagtctctactggctacacatacatactcttaatcctacacaatctatacactccaccaccacgcacaccgaacacaccagaagactcgtaccccccaccgcccaaactactcaagcagaacacgagagacacagcgataaagacggagcgcaagcacagaacggagaggcgggagggacgagcagccgccaccgatcgctgcacacgcgcgagaccccacggcgtgccagtacgacacacctgcacagaaggtagacgaggacagcagggaacacgacacgggcgcggacgaagagcggcaacagcgcgcgccgccgcctaagcaaaagagacagacaagagaagagagagcggaccggagacgggacctaaaaaagagcctccactcgcccaat

SEQ ID NO: 106148 - DNA, 3935 bp, Homo sapiens
ttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggactccttccgcccacccattcctcctcccgagtcctttccccttctcaagtgcagcctg

SEQ ID NO: 106149 - DNA, 3840 bp, Homo sapiens
actgacttcccgacgtttatgttattgaggagatcatcgtcgtaaatgtatcgtccaggtgagcatgacgactgcccaactgcaactactggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 106150 - DNA, 1425 bp, Homo sapiens
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaacat

SEQ ID NO: 106151 - DNA, 576 bp, Homo sapiens
gtaaggctgggttgtggtgtcagcacgactggcccattggaccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaa

SEQ ID NO: 106152 - DNA, 374 bp, Homo sapiens
cagagagggaagtggaatatttcaaaaggtaaatgtggaggctgtgtctgaaaccgtggtgactgtgtgcttgccatacatgtttggttttctgtctttccatggcacttctagttgtcttggacgaagttacatcaagcaagccagacaacatggcttctgaagagccttgtagtaggacaggccagccacacacacccctcccatactcccaacactcacacaatcacttctgctccccctcacatgctagaaaaatagttgatggcagtggcttcccccccacccttccccgccaactggctgttgcgcttctgaggcggtggctctccaggtgtcctgggccagcagcgtctcctggggatacaggcccc

SEQ ID NO: 106153 - DNA, 269 bp, Homo sapiens
gccctctgccaggccgcacgctccatcagcaccttccttggcactctggtaagagagaaaacgtgtttttctttctgtttggatgagctgaagagaagcatgtggcaagaggaagcttctcacgcatgtgtgccgacctcgctgtcacacccccacacactgtgataggcccctcttctctacgggagaggacctgtttcctctcctctttgtctttcctctggactttgccactggataaaagcattgggtggattgatacgcaggtg

SEQ ID NO: 106154 - DNA, 409 bp, Homo sapiens
aaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtaaggcttgaaggctcactggccctcggggtctgcaggaaggctgggcttactgacttctcgtctttgtaactcatctttgtaactgccttttacttggcctagccagagggtaagtgtaattaactgcccaaaaatgctcacacacagagagctgatcccctaggactttgattagaattttagctgttgtgctagattcctctggggcttcgctgcactgtcttg

SEQ ID NO: 106155 - DNA, 457 bp, Homo sapiens
cgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggaatttgttaaaactttcttgaagttttaaaataacctgagtagactgacatctttgccgtagtctcccgtggaagccctggcgcagctgtagccagctgctgctccaccacctctgtctccagtgggaggcccctcggggctgtcatcctactccatcctctcgcatctgccaccagtcggtcccactgtgtgacagagcggagcaagactctggctccatggctgcccgtcagcccggtgagccacatgggcgtggcc

SEQ ID NO: 106156 - DNA, 583 bp, Homo sapiens
aaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggcctccggatacagcttggtgtttcccacacattccgttgctacccgaggctctgttgctctgtctcctggtgtagcgcatccatgtggcttcttcacgcttgggaagctggctgggttctatgct

SEQ ID NO: 106157 - DNA, 4846 bp, Homo sapiens
cacaatgacatgcagacctgcatattggagctggacggagaaactgggctaatgtgacagacagcaacaagagtaaggcagttgcttcgctattgagagaaagaaccatatgaagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggctctgcgagagggacccctaccagctgtaccagcgtctggaacagcaagctcgagagtatgtgctggagatgaaggtccgcctgctccggcagctgtcggctgcggccaaggtgaaggcaccatctggcctgcagggcccgccgcaagcgcaccagttcatctccctcctgcttgaggagtacggcgccctctgccaggccgcacgctccatcagcaccttccttggcactctggaaaatgaacacttgaaaaagttccaagtgacgtgggaactgcataataaacacctgtttgaaaatctggtcttttcggagccacttcttcagagcaacttgcccgcactggtgtcacagatcaggctaggaaccaccacacacgacacctgcagtgaggacacatacagtaccttgctgcagaggtaccagcgttccgaggaggagctgcgcagagtcgccgaggagtggctggagtgccagaagaggatcgacgcctatgtcgacgagcagatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatggagtttcgctcttgttgcccagtctggggtacaatggtgcaatcttggctcactgcaaccttcgcctcccaggttcaagcgattgtgctgcctcagcctcccaagtagttggaattacagatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 106158 - DNA, 4666 bp, Homo sapiens
ttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 106159 - DNA, 4395 bp, Homo sapiens
ccacagagcaggggtccctaacccttgggtcacagaccagtactagtccatggcctgttaggaaccaggctgcacagcaggaggtgagtggccggtgagccagtgaagcctgtcagtgtttatagccactccctattgcttgcattaccgcctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccactaattgtgcattgtgcatttgtcccctttttttggcttccactaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagacagagagggaagtggaatatttcaaaaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagta

SEQ ID NO: 106160 - DNA, 4112 bp, Homo sapiens
ttttgtatttttggtagagacggggtttcaccgtgttgcccaggctggaagtttgaaatcaattatttttatgtttgctgtctgaaattcattctttctctgttgtttgacacatacataagcctgcaggtacccaaatttgttccaaaaaaaaaaaaatttccctgaggctgtgaggagagagtcaaggaagaggtttttattgatgttatttatcaaacaactcttacactgtacactaagattttataataactgcagacatatacaatgaaaagggagaattggcaccaatattgaatcttcccatccaagaatatggtatgtcactcttttttaaggtttttaaaaatatattgtattatggttttatagtttgtaaatcttgacccattttgtgcctccatagtctgtagtttgaggggctgctatgaccggcatcttgagtggggaatgtgtgtttaaagcattcatgctggaaactgggaaaatggagatgccctgtgaccagtcatctcgccagatgccggcattaactcttgtagtttttgagttgagtcttgaatctgggagtctaggaaatcacggtatcttctacaaataatgataggtttatctcatcttttccagcatttgtcccctttttttggcttccactaggaccttcagaccagtgtgaataagagcattgatactggcacccttgtccagtcctggcttcgaggggctgctatgacaatgaaaaccaagcagcgcatgttaacagaagactgggagctttttaaacaaagaagattcattgaagaacagttaaccaataagaaagcagttactggcgagaacaacttcacagacaccatgaggcacatgttatcgtcccggctgagcatgcccgactgccccaactgcaactacaggagaagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggctgaacaagctccaaacacttgtgaatgtcatgtttgtaagcaggaagcttctggactgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctgggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcgggcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacatcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattgatgatgtctttctacctaaagatattgacctagacagtgtggatatggatgagatctcgagaattctcgagatctacttcaggatgtttacaacatttgctgcccacttttcctaggtttctcgagacctctacaagagttggagttaagagttggagtgacactggggtactttcttggtgtaacgaactaatagcgcattctggaatttgtactctccaagctgctcaaaaagctcacaattttgtttgattaaattctgaggctcttccacaagaggtttaaattcatcgaacactttggcatagcattcatgagg

SEQ ID NO: 106161 - DNA, 151 bp, Homo sapiens
caacaatgtgagtcattgcctcccgggccggccacttgctgatgagcttgtatgcggttttgcagtgaccctgactgcgaagggcaccgctgcgagaatggtgtctacgacccacagcaggatgatggggacgagagtgcagatgaggaca

SEQ ID NO: 106162 - DNA, 582 bp, Homo sapiens
tcaactgaaagaatttttttaaatttttacaaataatatgacatggtttggctgtgtccccacccaaaactcatattgaattgtagttcctataatccccatgtgtcatgggaggaatgtagtgggaagtaattgaatcatgggggcagttaccccaatgctattctcgtgatagtgagtgagtttctcatgaggtctgttggttttatgaggggcttttccccctttactcaacacttctcctccctgccgccatgtgaagaaggtgcctttcttcccctttgccttctgcgatgattgtaagtttcctgaggccttaccagccatgtggaactgtgagtaaattaaacctcttttctttataaattacccagtcttgggtatttcttcatagcagcatgagaatgaactaatgcataataaatttagaaagttggctgagatatcaaactaacatgcagaaatcaatagtagatagatgatagatagatagatagatagatagatagatagacagatgatagatagatagatgatagatagatagatatagatagatagacagacagacagacagacaga

SEQ ID NO: 106163 - DNA, 249 bp, Homo sapiens
aaaacgtacttttttctaaatcatttaattgtagaagacataacatagctaacctatacatgaagctgtgatgatatttaatgaaataagagacctgcttatcctatgatgatatattaatgcaataagagatctgctacatatctgcttctcaggctgcttctcaggctgtattttattatttattttaaaacgccatattttcttcattatgaaagtgatgcatgttcataataaaatacttatgaa

SEQ ID NO: 106164 - DNA, 801 bp, Homo sapiens
ctctttgattatctcttttcatattttttctgtaaaactctctgcgtcatttggtattatttccctccagttcagcttcattatcagctgatttctctattgtattcagcaataccctgagtgaactattgctcagcaatttgatccagttaagttgggtcaggaatagtatttaaggccagtctttaaactttgtcatgactttagggtcgctattcttagctacattttttcatacattctggtaaagtatctggcctatgtttcagattgctgatcttgattgagaagagccattgctactgagagtgtccttaatttaaaactcctacatgttctataaagtcatattttgtaaggggagcttcatagctctctttccttatactcttcccttctctctggctaactatatgactaactactctgggcactaggcaggccactagactgtgttctcttatgcttgcctctcctaacatggaaactgcccaataaatgagctagggcaagagcatttgggggtcccagaattctcagcttaccacattggggttagagcttctatcctctatgtagagactgggtgtaggtaaaaggtcccacttcttggtcacactcactattaatttggcctctttaactaggagttggaggagataaaacatgttgatgacctacccctctaggtgagagatagagtaaaccttaatttggatttcagagtagagagtctatcttcttggctatatccacctgatataaaatttctgtcaagatgagcccaggataggtgaagga

SEQ ID NO: 106165 - DNA, 390 bp, Homo sapiens
tactctgagaagtgtcccatctattctctaattatataacattgtcactgacttgatagccatgatagatttgcatggttgtaccttcactatttaaaaactgatatgcctggtgcggtgactcacacctgtaataccagcactttgggaggccaaggctggtggaacacctgaggtcgggagtttgagaccagcctgaccaacatggagaaacctcgtctctactaaaaatacaaaattatccagacgtggtggcacacgcctgtagtcccagctactcgggatgctgaggcaggagaattgcttgaacctgggaagcagaggtttgcggtgagccaagatcgcagcagtgtactccagcctgggcaacaagagtgaaactccatctca

SEQ ID NO: 106166 - DNA, 453 bp, Homo sapiens
caataagtagaagcacacgaaggatattagtcttggatagaggccacagagcttgggtctaggtttttctttttcacatggggacagaaggtgaggcctccagtattaggcaggcagaaaactacaagtaatttaactgagagcttggaacattaactgtttttatgaagaagagactacaaaatctccaatcatgggcctggggaagtatcagaattgaattagctcatcagagtattagtaagctacaaaacaggtctgagaaaagttacctagaatgcctcaaaaatgataattatagaaatttaatatggaaaaaagaagttaacaaagacagaggatagattaacaaggtcaaacatagcttaataagggttctggaaagagaaaattgagaaggtgggaagatgaaatagacaaaaagatgatgaaaaaaatattccagaattgtaa

SEQ ID NO: 106167 - DNA, 457 bp, Homo sapiens
tggaaggctggtgatgcctctcccttagtgctcctgcagccccgaggtaccctattcccataccacagctgtcctgtacccacctactccctgcctgtctccctagaggaaagtgagtgcctggggagccagaggcagagggcactactatcacaaaggggactcaagataatgtgcagagcgagtgcttggcagttgggctttaggcattccaacaggtcagctaaaaaagcagattcagccgaatattcattcagccagcactctctgggctgtcacccccaattccaggagttgcatcccactcagcttcccacaccttgcaaaaccgcccctctttctcagcacctgtgactgccccacatggatctgccaacctttctaggcctctgcaggtggaacttatctggtatcctcatttctcagtttcccccatattcatttttggaaaataggc

SEQ ID NO: 106168 - DNA, 344 bp, Homo sapiens
tgaatgcataaatcaatatatcacagccttgtttctgtcccagctattgtgtactgggtccagtagtcttactccctggcccataccttttctttgactcccagtctacacatacagcagaaaaggtggtttccattaaatagttattttagtaatcttgattttttttctagaactcagcttcagaaatacatattgtatagaaataattaaatgtgaatttttaacttttttttctactagcttacctgaattatattttgctgggcctgagctcagcattacccaaagtaattctgtggaatggatatatgataagtgttacataaaagggggttctataa

SEQ ID NO: 106169 - DNA, 211 bp, Homo sapiens
ctctcatgaatcctgtgaggtaagtcttgttattctcatttaacacaagaggaaactgaatgttaaaaaagaaatgatggtggcacctatagtcccagctacttgggaggctgaggcaggagaattgtttgaaccggggaggtggagattgcagtgagctgagatcaagccactgccctccagtctgggcgtcagaacaagactctgtctc

SEQ ID NO: 106170 - DNA, 213 bp, Homo sapiens
tgacccctctgtcctggacagtgaagattctgagagcaggtccggtggaatggacgctggcacaggtccaatgatgaccatggtataggggagagagctgggaggtcgggagcctggttcaggctgtgacctaatttgctctgtgactgggcaagtctttgccttttactgaaccccagtttccccaaatgcccaaagagggtaggggagggg

SEQ ID NO: 106171 - DNA, 346 bp, Homo sapiens
tccttctctattggtctatggaagttatacttctttctcaataggttttatataggacttctctgccactcaggggagaatattctagcttcaaatcccaatgaattatctgcttgaacacttcactaatagagtttatcatatccttacccttttcatagttctgaatccattcagttccttttttcctctgaagacctgcctcctggaatgctatatccactgggtctagtctgccctggttactctctagggtcattccaaagctgtcattgtgagacttactttcactgttccatggacatcaccctgttacttggatcttatgttttctttatggcttaca

SEQ ID NO: 106172 - DNA, 356 bp, Homo sapiens
agacgaagtctcactgttgcccaggatggagaatagtggtgtgatctcagctcactgctacctccacctcctgggtttgagcgattctcctgcctcagcctccagagtagctggtattacagatgtgtaccaccatacccggctaattttggtatttttagtagagacagggtttcgccatgttggccaggctggtctcgaactcctgatctcaggtaatctgcccgcctcggcctcccaatgtgctgagattacaggcatgaaccaccatgcctggcccatcgtcattttaaaatttaattttaattggtagtgtggtaattattgtccagcaattaagtgtttattactgccag

SEQ ID NO: 106173 - DNA, 370 bp, Homo sapiens
taaaagggtatgtgcctgttaatggtggttacctttggagacaagcactggcatttgaatgcaagactgaaaatcttacttttcactttacttttgtatattgtttagagtatgcagccaatgcatgtatttcaaagaaatgacaccctgatataaacattactgggaattctgcacatgacattcccaactatatgtgtaagcactggtttttaagaagatgatgtatcaggctattggtttgttaacgccgttgttttgcttgcttatcactatccataaaccatgacaaaaagacaataactttctgcatcttccgctgttttctggtagcatgtttattgctcagtcctgatggtttcatatagag

SEQ ID NO: 106174 - DNA, 748 bp, Homo sapiens
agaagaggttttttacatgttgatttttctgttgctatggttactctccttgtcatcctgacagtgagttgaaagccattgacagtattaatctctgtggctgagcttaggctatttttagatatgccgtacttcacacataattgcacgtgggtgagcaacctacgctagtctgatctgtgagcagctgggctgagctgccagctgtttacagggaatacatgagctgctcatccttctgggctctaatgcccataccctcctgctcccaatggaagtgtttccattcatctgtttggtatttggacaccttggtttccagcagcttgccctttcattgatgagtcatacagataattagatggttaaatgcaattaatgaaggaaaatttgatttcccatgcttctgttgagagtactgtagctcataggatcgtagaatattaaagatgtaaaagccctagaagtcaacctagctgttctttatttgcagatgaggaagccaaggcccaggaagggtgagtgacgcttccagctagctggcaacgagagtccagacctgaatctagtccttggcttctctttcactgattagtctactgaggccacacttgaatcagcagtaggatttcaaatcttgttattttattgcacccatcgtaactgattttgtacttgtcataatatttatgcatgaattagctgaaaaaggaggccagttttgaacatcagtttatttgcctccata

SEQ ID NO: 106175 - DNA, 260 bp, Homo sapiens
gaaaggtttttgactagtagaatactcacagtgccccaaaatatcacctcacagattatttttaatttaaaaatcatgcagtcatgcttaaaatggtgaaatctggtacacactaccttaatcgagtcatcaaactcagcatcaccaagcatgggccaaactgacccttgagcttcctgatgggatgcagcagaagggatgtggcctcacgcatgtgatattcctgcctgacttatttaatctgaatccagtcatcaaga

SEQ ID NO: 106176 - DNA, 510 bp, Homo sapiens
cggcctcccaaagtgctggggttataggtgtgagccactgcagctggcccagatatagatttttgatcgatgggattttcaggattgctttgagaagaaacatcacaccaaagggatttaggcgtttgtcactttacttgtggtgtggagaagggaatggcgggtaactgtgtcacacacctgtatggctagctgggaagagaggaaagggatctttggaatctggaccagtacatacagcacagacaaaagtggggcctggtctgttgcaggagttgcatacattacaaataagtccctggccttcaagttctttaaattcttagttttatttctaggcctcaatgccttttaaatcctgacaggaagatgaaaaaaaaaaaatcaagtgcgggattttcattcttcttaactgatggaaacgattgccattttatgtttaatgttttcatgtgtcaccaaagagcattaaccttggagtcggccggccgcgaatttagtagtagtagg

SEQ ID NO: 106177 - DNA, 818 bp, Homo sapiens
tcagtgtgcccagctcctggaaaagtggactcaagagaggttctggtgacaaaaaacctccacaagaaactacagtttcaatccacagtgggttgcgcctgcaaagaaatttttacaacaccaaccattcctaaggaccatctattccttccttaattaaaagtatatagttaaaaatacttagagaaacagcttagaatagtctttagagtcagacagactgaaaatgtctgtattcatgtgaacctggaagtgtcattggccctctctgagccttggatgcatctgtaggatgaggaatgtagtacctacctcgctgggttattttgagaaagaaataaaaatatccttgcacacagtaagtactcaaatggaatgaaataaaagatagtaagggctcctgtttcaaatcctgtctgtaacatagcatttgatccttcctactgtaaaataattggcatttatcatcaacatcccacagtgatgtgtctcatgctgtctcactgttgtgaaaccacaaaaatcagctgaaaagtctaagaagagtaggtcctgatcattgtttcattaacgtatgagctttgggaagggcagacaacccacaaatttacaaatagtatatggattttcacaaaacaagcagatttgttcagatttagatttcaaccaatttcatgaaagcagacacaggagatgcaaactgcttttgtggattccgttctaggggcggaagcagctctcaaggtgtgtttaagtgtgcatgctttggcgtccctgttcttttgcagatattagggggagggagggtatggtctttg

SEQ ID NO: 106178 - DNA, 329 bp, Homo sapiens
gagaaggtacagaattatggtctccttcatcactgtaccttctctccttatgtatgtccaaactctactgaggagaaataataaagtttttcttatttctccttatgtatgtccaaactctactgaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaagtaaaaaaaa

SEQ ID NO: 106179 - DNA, 1863 bp, Homo sapiens
ctcactgatacatatcccttcacacttctataatttaactctctcaactgcatgtgaaagatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatctaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaagtaaaaaaaa

SEQ ID NO: 106180 - DNA, 859 bp, Homo sapiens
gggctgcaggaattcggcacgatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtgaaacaggcgtacatcaggggctgttcttttgctgcaaatgaagttgatggaattacactgtgatacgactgactggtagactcaaatattctatttctttccaactttatattcttgtcataacaacccagtattctctgaggcaaatggatgcttatgaccaactggcctgaaatgggggaatatagggttagtggtgagtcacatataagaaaatgcaagagaatagcagtgtatcatatttcaaaataaaatacaaactatacataaaa

SEQ ID NO: 106181 - DNA, 1824 bp, Homo sapiens
gggctgcaggaattcggcacgatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatctaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaagtaaaaaaaa

SEQ ID NO: 106182 - DNA, 1345 bp, Homo sapiens
gggctgcaggaattcggcacgatcttagctgaagatgactgacagtgttatttattccatgttagagttgcctacggcaacccaagcccagaatgactatggaccacagcaaaaatcttcctcttccaggccttcttgttcttgccttgtggcaatagctttggggcttctgactgcagttcttctgagtgtgctgctataccagtggatcctgtgccagggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatgagcctgctccaagttttcctcagtgaggccttttgctggattggtctgaggaacaattctggctggaggtgggaagatggatcacctctaaacttctcaaggatttcttctaatagctttgtgcagacatgcggtgccatcaacaaaaatggtcttcaagcctcaagctgtgaagttcctttacactgggtgtgttgtccctttgcagatcaagctttattctgaagaataaacctagctggcatgctggtgtgtacctgtagtcctagctatttgggaagctgaggtgggagggtcgcttgagcccaggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctccttctgagctcttcacacgtaatgcaaaaacccggtcttaactgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatgtggttggatcaccaaattatcttaggtactaaggcctcaaaaataagaaaaactttattatttctcctcagtagagtttggacatacataaggagagaaggtacagtgatgaaggagaccataattctgtagtgttgatgatcctggattataatctttttctctttatctttcatagtttttttaaaaacatggactgtatcttatctaccactatatcccaaatacctaagatagtgcttacgttcagtgactattaaataaataaatggatgaattaaaaagtaaaaaaaa

SEQ ID NO: 106183 - DNA, 148 bp, Homo sapiens
tttaaatgctaccaattataaatgctaccatataaaaattatgaattataaataccgctccaatatcagatatgctaaaatgtgacctaatctttaaatcatcctgcaaaatagcaataattgtatcattttacttaattaaaatatt

SEQ ID NO: 106184 - DNA, 281 bp, Homo sapiens
aatgattccactggggctatggatttggggaaggaagaccacagagataagcttgacatgcactagctagacgaggcagaccatgttaaaattttccattgtgaagttaattcttctttcccctcttttcatattgaactgtggaaagaagtcactctatatacagcctacacataaagactggaggtgtagggagttatgttccacatctttgagtgggagtatatctgcattattagagatgttaaaattatttagaatttttctacagacaagatttg

SEQ ID NO: 106185 - DNA, 376 bp, Homo sapiens
  misc_feature (227)..(227): n is a, c, g, or t
cctcccttccatgtctctgttcttgcttccttccctcggtctgccgtcgccctttgtcagtgatcagacgtgaccatgggtaacaggcatgaattttagtctctgcatgctcaggtgtgtaagaaacatggcttcctttagttcctataactaaactttattttcagtttgcactgatcttcctccagctgccctcccagcccagcagggcttctgcctggcagggnatgggatcagaactcaaagcccctttcatgcaaccgtgtgtgcacagttacacacagatctgtcttaaaatctaactagtagggaagcagtgagaacttgggtgctttgtagagaggctttgtgattcagataacagggctagctccag

SEQ ID NO: 106186 - DNA, 411 bp, Homo sapiens
gaaaccttgagggacacgactgtctacacttctaattggaaagccgtatctgattcattcaaatgttcagatcttcaaaaagtaaagtggcctagagtggaatcttaaagttgagagtatggactcagggagatgctgttcattagccaggataagagatgtggtttgaaagagctggacttccttttctcactttgcaattgacctgctgactaaacttgggctactcacttcttaacctcagtctgtcttgaatttcccctgtgcaaaaaaacatgggaagacaatatctaaatgcctctcagggatgttgtgaagaggacctcatcgatgttttaaaccacatggtcctaggaaggtgctatatattaccatcattaaaatcacctgtggttggctgcagccctcccc

SEQ ID NO: 106187 - DNA, 814 bp, Homo sapiens
gagagcagggaggctgcggtggatcagctgcctgctgtctctgactggaagccactacctttagggcagggactccgactacttcactcgccaccggatcatctgggttttgaagaaaccaagatgcctttcattaattcttccaactaaattaatggagtcactgcatctcgaacaccattagcagagcagagacaagagttttggctggaaaagggttcctgcttttttatcttcttcattttctcttgccaccaccatgtaagaagtgcctttcacctcccacgatgatcctgaggtctccccagccatgtggaactatgtgcacaatcattatcactgatgtacctgtgtcttcagcctgtttgactacactggggtgaggacgttgtggaacagatggattattatctacctgggctcacacagctaggaggtgataaaggaaagaagcagcatgtagccattggacccaacccctcagccactgtagagcttgagagagctggatctctccaagttatatccagctttttaattatctgacaaaggagaacatgaaggatgaattccatcatcaccaaaaagtcatagtgatattaacacatgccctgataacctgagaaaactgctgtgaaaccagagaacagtttgataatgagcctgggacatatacaagaaaacctgagctatagagtgagtgtctgcaaaggccgagagggctcccactatgttcattctcctggaggttgcttttatccaactcacagttgcttcttttgctctttatggaggtgtttggaaatcttgaaat

SEQ ID NO: 106188 - DNA, 1881 bp, Homo sapiens
  misc_feature (181)..(181): n is a, c, g, or t
gaatactaggctttcctttttttgtgagatgggggtctcacactgtggctcaggctggagtgcagtggtgtgatcatggctcactgcagcctcgaagccccggggtcaagtgatcctctcacctcagcctcctgggtagctggaaccacaggcacgcaaccaccactcctggctagttttntttttttagtagaataaggtctcactgtgttgcacaggctggtctctaactccttacctcaagccatcctcccgccttggcctcccaaacatgttgggattacaggtgtgagccactggacctggccaaatactgggttttcagtgctcactgccactaataaaaatctgaaattctttcattatgcaatttctaagtgcctggtgagggccaagctcagttctaggctctgaagattaagagagaaacaaggctctgtctgctcctgttgtctctgtgagcatctttgacagagtgctcagattgttgggatatagtgcatcggactggcagcctgaatttgtggagaccgcagtcagtaactttgtgatatatggaatatttagaggacagtaacccatttccctacgccctacctgatcacatcgtgccctgctgggccataccccaaacagcccaccttcctctaggcctggccatggccctgtgcctgccacattgaggattaagtcaggatatcttgagccctctcaaatccctgtttattcaggcctctgccacatatagagccagccttctgtccccaccacttccactaccatggagcccacttagtaaaacgctctctgggcccagcttcgccagaaaagacaccaggggagcaaggctcaaaccaggggcagctaaatctgatcttgtggaccagtctctagtaagggctttcagcgtggctgtctgtccattgctttccaaataggatgcagcaatgattggtacatgggtattaagatcggtagtaggggctagtccaagtttagcaatagccaaactggagagcctctgaagtatgagagtcccagagggatttgtcagctcctggcagacatcctgattttcaccttcctgagtctaccctaccccagagggtgccagtctcactgtggtgatggttagcccagtgtgtgctgcactcacacaccagcacggggtccgtgcttgcaggctggtggatgctgtcctctgggttaagactgtctcccttctcgggagcactggagggttctccatctgcgtgtttcagtggaagttggcagatacgaaaacaggcccctatagggaagcagttccatgaaaatgattaattctttccaaaagacttaaaattttttcctatttcaattttcctttcaaaaaaggaaatacattcatgtagttcaaaacttaagaaaacaaaagtctgttcagcaaaagactcccactccggttccccaaacgctgagccccaccccccatccctggtagcaagaagtgtttccaattttaaggttaagaaacaaagtccctggatttgtgttagggatgtcttcctgagagtgggttgtgttccgtttgaccctggcggttgacctcggcccactaggatcatgccgccctctccagggaggagggcctccccatcaccctgtacagtggcaccccagccctggcactgcccgcccttgctcagcgtacctttcccatggcactctgacgtactggatgtttggtttctgaagttactggctgtttaccctgccgggatgtaagcccctccagggcaggggcttgtctcgtgttcagtgctgcatcccagctgctgggcacggtgcctggtccatggcgttcaataaataactgttggatgagtgaaaaaaaaaaaa

SEQ ID NO: 106189 - DNA, 1063 bp, Homo sapiens
ttggtcactctacaggatcttctggcaaggtggaaatcaggggcagctaaatctgatcttgtggaccagtctctagtaagggctttcagcgtggctgtctgtccattgctttccaaataggatgcagcaatgattggtacatgggtattaagatcggtagtaggggctagtccaagtttagcaatagccaaactggagagcctctgaagtatgagagtcccagagggatttgtcagctcctggcagacatcctgattttcaccttcctgagtctaccctaccccagagggtgccagtctcactgtggtgatggttagcccagtgtgtgctgcactcacacaccagcacggggtccgtgcttgcaggctggtggatgctgtcctctgggttaagactgtctcccttctcgggagcactggagggttctccatctgcgtgtttcagtggaagttggcagatacgaaaacaggcccctatagggaagcagttccatgaaaatgattaattctttccaaaagacttaaaattttttcctatttcaattttcctttcaaaaaaggaaatacattcatgtagttcaaaacttaagaaaacaaaagtctgttcagcaaaagactcccactccggttccccaaacgctgagccccaccccccatccctggtagcaagaagtgtttccaattttaaggttaagaaacaaagtccctggatttgtgttagggatgtcttcctgagagtgggttgtgttccgtttgaccctggcggttgacctcggcccactaggatcatgccgccctctccagggaggagggcctccccatcaccctgtacagtggcaccccagccctggcactgcccgcccttgctcagcgtacctttcccatggcactctgacgtactggatgtttggtttctgaagttactggctgtttaccctgccgggatgtaagcccctccagggcaggggcttgtctcgtgttcagtgctgcatcccagctgctgggcacggtgcctggtccatggcgttcaataaataactgttggatgagtgaaaaaaaaaaaa

SEQ ID NO: 106190 - DNA, 1827 bp, Homo sapiens
  misc_feature (181)..(181): n is a, c, g, or t
gaatactaggctttcctttttttgtgagatgggggtctcacactgtggctcaggctggagtgcagtggtgtgatcatggctcactgcagcctcgaagccccggggtcaagtgatcctctcacctcagcctcctgggtagctggaaccacaggcacgcaaccaccactcctggctagttttntttttttagtagaataaggtctcactgtgttgcacaggctggtctctaactccttacctcaagccatcctcccgccttggcctcccaaacatgttgggattacaggtgtgagccactggacctggccaaatactgggttttcagtgctcactgccactaataaaaatctgaaattctttcattatgcaatttctaagtgcctggtgagggccaagctcagttctaggctctgaagattaagagagaaacaaggctctgtctgctcctgttgtctctgtgagcatctttgacagagtgctcagattgttgggatatagtgcatcggactggcagcctgaatttgtggagaccgcagtcagtaactttgtgatatatggaatatttagaggacagtaacccatttccctacgccctacctgatcacatcgtgccctgctgggccataccccaaacagcccaccttcctctaggcctggccatggccctgtgcctgccacattgaggattaagtcaggatatcttgagccctctcaaatccctgtttattcaggcctctgccacatatagagccagccttctgtccccaccacttccactaccatggagcccacttagtaaaacgctctctgggcccagcttcgccagaaaagacaccaggggagcaaggctcaaaccaggggcagctaaatctgatcttgtggaccagtctctagtaagggctttcagcgtggctgtctgtccattgctttccaaataggatgcagcaatgattggtacatgggtattaagatcggtagtaggggctagtccaagtttagcaatagccaaactggagagcctctgaagtatgagagtcccagagggatttgtcagctcctggcagacatcctgattttcaccttcctgagtctaccctaccccagagggtgccagtctcactgtggtgatggttagcccagtgtgtgctgcactcacacaccagcacggggtccgtgcttgcaggctggtggatgctgtcctctgggttaagactgtctcccttctcgggagcactggagggttctccatctgcgtgtttcagtggaagttggcagatacgaaaacaggcccctatagggaagcagttccatgaaaatgattaattctttccaaaagacttaaaattttttcctatttcaattttcctttcaaaaaaggaaatacattcatgtagttcaaaacttaagaaaacaaaagtctgttcagcaacaagaagtgtttccaattttaaggttaagaaacaaagtccctggatttgtgttagggatgtcttcctgagagtgggttgtgttccgtttgaccctggcggttgacctcggcccactaggatcatgccgccctctccagggaggagggcctccccatcaccctgtacagtggcaccccagccctggcactgcccgcccttgctcagcgtacctttcccatggcactctgacgtactggatgtttggtttctgaagttactggctgtttaccctgccgggatgtaagcccctccagggcaggggcttgtctcgtgttcagtgctgcatcccagctgctgggcacggtgcctggtccatggcgttcaataaataactgttggatgagtgaaaaaaaaaaaa

SEQ ID NO: 106191 - DNA, 475 bp, Homo sapiens
taaatactcccccgcgtcgacaaaagactcccactccggttccccaaacgctgagccccaccccccatccctggtagcaagaagtgtttccaattttaaggttaagaaacaaagtccctggatttgtgttagggatgtcttcctgagagtgggttgtgttccgtttgaccctggcggttgacctcggcccactaggatcatgccgccctctccagggaggagggcctccccatcaccctgtacagtggcaccccagccctggcactgcccgcccttgctcagcgtacctttcccatggcactctgacgtactggatgtttggtttctgaagttactggctgtttaccctgccgggatgtaagcccctccagggcaggggcttgtctcgtgttcagtgctgcatcccagctgctgggcacggtgcctggtccatggcgttcaataaataactgttggatgagtgaaaaaaaaaaaa

SEQ ID NO: 106192 - DNA, 455 bp, Homo sapiens
caggtgtttatctctcggcagcagccaattaccaccttgcactcatgcagggcccagagtgcagatgggcttctccaggtaatcctgctccaccctcaacccttggcatgtcctgcatggctatgttaccatggggcctctctcaggccctgtcccactccacatcattctcatgagcatccagtggaggactgtaggaagaaactgagggtacaggttacccttgtgtctggggctcccagtaaactgccactctagataatgctcagccattaagatttcattaagatactagtcattttctccttatctacttttgcggcaactacctattcctctgtgctctgtcaaacatgaaacagatcatgtgtttcatccatcaaagataatgtgttctagttacctccagaaaccagtttgcttggtggcctgtgaccccagctctccagtaggct

SEQ ID NO: 106193 - DNA, 308 bp, Homo sapiens
tgggacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtattttgtatttagaaatctttttatacaagaaaatgggaacttgagacctataaagtaaaagatttcataacaataataaaactccttgcagacgtctaaaggctattctaagttaaacagattgactaatatcacattttttagtctat

SEQ ID NO: 106194 - DNA, 389 bp, Homo sapiens
aactgattgaataatgcagttgctgtaacaactgaataattcaatcaactgaactcattcttcagcgagtggagatgaatcctccactctctttggcctttgagatatttgagagccatatttgagaggtggaggtggaaggacgtcctcaatgtggaaaagcaaacaagggccattgaaagcagttgaggacaggactaaactcggatttttttttttttttatgctgcccaaattcttatctaaggggtctggggactcatgccctacaaactataaattcttatcaaatgggtttcatttaaccctgtatatcatgacttactttccaatctgactctggcataacattacctgacaaagaagaaagtggaaatattttaccccaa

SEQ ID NO: 106195 - DNA, 227 bp, Homo sapiens
tgaggatagtaacagtccctaccatcagaggtgattatagagaaataaatgagataatgcacataaagaattgataacagggcttggcatatgatagattctcaaaaattttagttattatttgacatgaattctgccctcacaaactgtaaaatatagatgaggatgccaaagtagtgtataaatgatgatggcataaggtagaaaagataactactattgaaata

SEQ ID NO: 106196 - DNA, 282 bp, Homo sapiens
tattaaaagaggctagccatgcggttccagaaaagatgaaatgaacacacttgtatttattcctactgagtggtataagcactgacaatacatgtaaaataagcacacagactgtgaaaggtggaaagaagagggtgatcgcagggaccttgcaactcaaaggaaaacagtgtcgggtgggtggtgtcccttgaggtttctttctgccttatttatcccagactagaaacaagagaaaccagcagccaaaaaatgccactcggatacagatcaactttttta

SEQ ID NO: 106197 - DNA, 548 bp, Homo sapiens
atttatatatttaaacattatttctaattatgtaattttcattgctgttaagtggaaatttatttgtgggaggggcatttgggggaaatataaatcgttttatattctttcctaagtcaattcacagggttatttttccccctgtacccacttagaacagtgtcttaaatcattctgtttttatgtgtatgcactttcagaaattttttaatttgaaaaatatcaaatatgttggaaatggaagagtaaaaatagactacgtgtttctactactgaatgatgtttttgagaaggttgagatgagtaaagagggaatactgtttctcgaactagtttaaaacaaccttgaatatgtgaggaactatttgggtttgttgaatatgtgatgttcttggtgtgttaaataccttcacttaaaaattaagtttttgaccatcaatcagtggaaacttgtttattttctttcttgttttctgtgattttttttttccttctcacgtaggaagatcggtatttatttacagttacttctattgcagcataaataa

SEQ ID NO: 106198 - DNA, 372 bp, Homo sapiens
ccagtccttgcctcttgaatccctctccccacctcaaaatttccctttctatttgaccttcaccactatgttttgtctcatctttcatgcctaagaccacatgtcgatcctttccaaagctccaacttcttaatttctccataacaggtctgtctgattccacggcgctggttctcttaacccctacattccttacgaccttgtgttttcactcctgcttgttttctttctcaaggtctaggtcagttatttcctacagaaacctgcccaaatttcattgacctatggttttcagttctatgagcaagccacaattgactactcacaaaggagatttattaatacggaaggagtgctcccatgataacttat

SEQ ID NO: 106199 - DNA, 285 bp, Homo sapiens
tatttttagtagagacgggggtttctccatgttggtcaggctggtctagaactcctgacctcaggtgatacccctgcctcagcctcccaattgctgggattacaagcgtgaagcattacatccaagtgaaacttcttgagatagttacataatgtttaaatctgctggtgtacaagttaataaagtgtagaactgaataaatattaaatattagatcaagtttctcatgtttaccttaacgtataaagatttatcttaaagcactgattttcacaaaataacatc

SEQ ID NO: 106200 - DNA, 304 bp, Homo sapiens
gtagagacgaggtgtcaccatgttggccaggctggtctcgagctcttgacctccggtaatccacccgcctcgccctcccaaagtgctgggattacaagcgtaaaccaccgcgcccgacctcctccccttatttcatccattttataattcacattattgatcgctgataattgcacctattgtaatgatactgataattgcacctgttgtaataatattgatattgataattgcacctattgtattacaatattattattgatatcgataatttcacctactgtaatgatcaataaaggcaggc

SEQ ID NO: 106201 - DNA, 315 bp, Homo sapiens
acagctaacatattaattctaagtagtgttggactgaaggtcaggaatctgattttgaccttagcactaatgggaatcctgtgggaatcctgagagtggctgaataagtgctgtaatatcactaataattaataatgatgataatgtcccaggtttcttattttagtgctttttagcccccgaaggcttcaaatcactttgcagaccaattgtttcacccactgttgacctgtaaccgactcagccatggaatattgccctgttgtcaagaacacagccacatttagcttgtttaagcatgaactgaagaaagat

SEQ ID NO: 106202 - DNA, 549 bp, Homo sapiens
taaaaaagaaagctgtgtaacaagagcatcagatgttactttgctcactgttgaaggcggtgaagaacagaagaaaactaggaagaaaaccaagctgggaagggcaatgaaggaacaggttagagttcaaaagtaaaagtacgttccacacaaaggaaagatttcagagagaaggctttgctctgttgcccaggctggaatgcagtggtgtgatcatggctcacgcagccttgaaattctgggctcaaatgatcttcttgcctcagcctcttgagtagctggaattacaggttgctggggcagctctgatccacatacgacttagggacccaggatgcagctgcttcaacatcttgtagccgtactatctggaatacatgggctgccagttgtcatgactactctcctatgttcagcccaaaagctaagcactttatttcttcatatagcccattggccagaattattcatatgtctcactacaggatgggccgggagtgtaccttcattatgtaggaaaaaataaaacataattcgtgagaattatcc

SEQ ID NO: 106203 - DNA, 238 bp, Homo sapiens
ctttttgttcttttcccattccatttctgtcggtcatattaggctaatgctaattagctactgctaatgctgcagtgaaaatttaattcccaaatgtcagcgacttaacacaacaaaagtttctcacttcacttccattgcaggttgctggggcagctctgatccacatacgacttagggacccaggatgcagctgcttcaacatcttgtagccgtactatctggaatacatgggctg

SEQ ID NO: 106204 - DNA, 751 bp, Homo sapiens
ggtgtgagccaccatgcccagcctacaattatgactatttccatttgaaaccatcttcctcagaaattgaaattttagagccgctcttgctagcatgtgaaaccttttccttgcttattgccttttggcgggggcagtgaaggaggagcctggcctttcaaaatgtgatcaaaaaaataaccaaactccagggctcattagtccttttataaacgccggtgtgaaatgatgggtatccgtgtgcctggtccaagtttcctggtggttgacttgggcgaataaaaataagacatgttctgcagagttctccttttaaattcttgtgtaatattccgtttgttttgctcctttgcaattaactacaaacttctaagtcctagaaaagatttcaagtatttatagagtgagcaacgatcattttcctagtcaaatagtatggcaaaaatcactgttttaaaaagttgtggcattaaactataaatcctccctcccctcgcttcccacccccaattatgaaagaaaagcatatgacaatgcctactgggctcagcttttgggctaattgagtctgactgagccttcttagcaggttcctgtcttttgaaacctcaaatcccaaaaagctgtctaataattttacttttttagggactaagaccaggtattttcagcagaggttcttacttttctgtaattgaggcgcaactataatgttccagaacacaatcttaaatctgaaagtgagaggaag

SEQ ID NO: 106205 - DNA, 390 bp, Homo sapiens
tctaggatcgcttccagtagaatgagtcactggcaaggctttgagtgcttcccctcttccccaatttcaaatggtgaattgcaaaatctcaagttatgtgttggcaactgatatctggaacaagaaagaacttgatatctttctgtcttgcaaattatgctcacccgcatctttatttaggcctaaaataaagtagcatgttggaattcatcagctgcacacatctctgaggtgacttttttttttttttttttgagatagggcctcgctctgtcaaccaggctgcagtgccgtggcatgatcatagctcactgtagccttgatctcttaggctcaaaccatcctcccgccttagcctcctgagtagctgggattacgggcctgtgccac

SEQ ID NO: 106206 - DNA, 532 bp, Homo sapiens
aggctaccgaggagggcgccaggcccccagggagcgtggaggatgcaggccagccgtggggcacattctggcccaggcctgtgtctacaggtgatcttgacagagccctgccggcggacacggggctccagaaagccagcgcggacgccgagctcctcgggctcctctgccagggggtggatatcccgctgcacgtgccggaccccaagtatcggcaggacctggtgtcccagggcggcagggaggtgtacccgtaccccagccccctgcacgccgtggctctacagagccccctgtttgtcctgactaaggaaaccccacagagaggtggcccctcgttccctagggagagccccaggggccccgcaggtctgaacaccatccagactgggccggtcctcgaggctggcccggccagggccagagcttatatcgacaggttgctgcatctgtggggccgggagaccccagcaaagggtagcgagggagaacagggacctctaaggcatgcagcgtccccatctccacagag

SEQ ID NO: 106207 - DNA, 286 bp, Homo sapiens
gccagctgagggaaggggtgggagcgaggggaggagtgtaccacaacacaacagctggcagctccagacccacacatactaacagctccgacaccagacagggaagaaaatgtgcttccctctaactccaatttaaagaatgtcagaaatagctctgattggcccaagttaaggtcatgtggctgctgcttggaccaatttctatagccaagaagatacactattatgattggcagctcctctagaatcccagtattggagtggaaatgaagtagtagccaaaaag

SEQ ID NO: 106208 - DNA, 210 bp, Homo sapiens
aatgccggcaaggatgcagagaaactggatcttctgtacactgctagcgggaatgtaaaatgaaacagccatgctggcaagtcacttggcagtttctaaaactaaatattgctgttactctatgacacagcaattgctctggggcatttaatccagagaaatgaaaactgttcgcacaaaaacctgtatgcataaacctccctcatagca

SEQ ID NO: 106209 - DNA, 297 bp, Homo sapiens
gagcagttggcatgttggctgttccgtaaacagggccgtgtgtctgctctaacagatggcctgggaaggtaaccccgaggctttgtgttccttcctgcagaccttcaggattccgcagagagagctggccctccctccagctgctggggctcttgtccttcccagctggggccagtccacctacagggggaatcctggagctgagggatcctaacttgggagatagtttctgtgctacccttcttgcctctcccctggacccctgaaggctctgtcctagggaggggatgggtcaca

SEQ ID NO: 106210 - DNA, 805 bp, Homo sapiens
gaatcaagccgagcgcgaacgccgtgtctggggctcccactcccgggacacacacgcgggctggcttacacatgctcttgctctctcgcgctctgggagagcgcttatatgggcttcatgaggctaagtaataaacactttgtcttcaccctgctatttatgggttgcttggggcatcctgtgctctccactgcccttacctgaacagacggctcatgcagacccggagtttaatagggacaacagtaaatctgagaggctgtgtgtgtcccacgcgctcctgttttcccagccacccatgctagttgcagagaaaagccaacctgtatcccttcggttatgctctgtgtgcccttcctggagagatcccttcattcttcagcaatggatcaaagaactctgaaaacaagaacaaccccgacagctgcaaaccacgagccctcacctccagcagaggttttcgggaaactctggacgaccacgcgcatgcagagggctctcagagcttccaggtcctgtaagaagagatggagtcatagctgcgccctgtccactctcgggctgtcacacaagcctggagcccagccatttctcggccttgtcttcatcttgggctaaccggtcgtctcctgcaaacagacagcacggagaaggatgagtgaactcggcctctccccacagaatacagttcgccattacagcgctgattaaatacaggacattatctcaccataatgccctcctggcggcgttcccaggaaaattctaactaatcataaaaatagaaagaaaaacgcaacctaaa

SEQ ID NO: 106211 - DNA, 339 bp, Homo sapiens
atcctaataaactccccttcatatatacatatagcctattagttctgtccctttaaagaaccctgactaatacagggagtgagttcattactgtgaaaatgggttcattataaaagaatgggttcagccccttcttgctctctcaccctctctttgcctttctgccattggataatgcagcaagaaagcttttgcaggaagccagcctctccatcttggacttcccaacctctagaactatgagccaatacatttctgtttattataaattagtctgtggtattgttatagcagctcaaaatgaactatgataataagaattcttaacatgtatgtgcc

SEQ ID NO: 106212 - DNA, 577 bp, Homo sapiens
gcagcaggtctcatcggggtcattgggaaatacaagaaaatgccaaaactctcaccacctactccaaattgagtaggtcagcaggtgggggctggacgtctatatttttacatgtaccctgggaaattctgacacaagaggcataagcaccactctttgggagactccatggagtagcaaacatgtgaactggcttcaggccccaaacatctgggtaccaggctggagaggagacatgctttcctgaagtctgtaggtggctttctgtttggatgtgatcctggcaatgactgccagatattcaccttgagttcctgctgcggagccacagcaggggtgtacctgtgtccaccccatggccaggggccaaggcagcgtgtgggtgctggtgtgagcatcttcacaccaactccatactccacagccctccgggaggtgaggcagtcaaacatttaggaccaggctacctgggttcaaatcccatttgtggaatttgcaaactgtttcaccctgggaaaattgctcctcctaggtttcctcccctgaaaaccgggaatgaaggctgatgaatattagc

SEQ ID NO: 106213 - DNA, 462 bp, Homo sapiens
ccaggagggctcaaaggagacagaaggagcagtcaaggaggagtcaaggaggagtcaagggccgaggaccaggagggctttgagtcctgaagcagaacagtgcatgtcagaaaggaggatggactgcagcagctttgtaggtcaagaagaacagggcatagtagacaaccgctgggtctgacagcgtggtggtccctggtagaatcatgtcgctaagagcctgactttggggtaaagaaaaaggaggaaaaggaatgggagacagagactacagacttactccttaatgaagctgtgctctacaaagaggagaaaaattgggacggtagctagcatgggaatatccaatgactgatccacgtggatgcaaacgcctgccccctggcctcaattcaggacaccttggcatggccaccccaagtccagggatctctgtgggctccgccaagattctggttgcag

SEQ ID NO: 106214 - DNA, 260 bp, Homo sapiens
taggtttttttttatttgttaaattttgagacaggatcccgctccatcacccaggctggagtgcagtggcacaatctcagctcactgtggcctctgactcctgagttcaggcgattctcattcgtcagcctcccaagagtacctgggactacagggtagattttattaataaggtcttattgataaaactatggtaatagtcccttcccctgaattttatttttaaaattcaacctacatccttgttgcaaacttagcaa

SEQ ID NO: 106215 - DNA, 532 bp, Homo sapiens
attgacatgacttgtctgctgtcattcattttcattctttgtggcttaaggtttatttgttttatccctttactgtcgctttattgagctttcaggaggaagtaaacaaacatttcactggaaatcaatattagaacttcaacttagctatcttgatagctttttaaagatttgttagaatatttccttttacattaaaaattgacttaatgataattaataatggataataatggaaaccatctgaattaccattagcattaatttaagatcagacaggatggtctagaaagattgatgaggcatcctctgatcgtcctcttcaaagttccaagattgtctccttcatgaggaattttagaggcaactcattaccaactttgtagttttgctttgtggcattattactccaactaacttaaaaaagtttcatttttgtaattaatattttgcctttttcatttatgttgaaatgcttatgtgctggtgtgccttagttattttcctttattgttttaagttcacatgtatg

SEQ ID NO: 106216 - DNA, 800 bp, Homo sapiens
attttcacttccacttttcataagaaatggtattctgaaagttgcgttttgtaggccacaatcattttttctctagcccttgtatagtatggagttacccctctggccactagatggagatcctgtttcattttaagaagtatttggtaatattcacatgttaatgttaacaggcagaatgttactttagagaccctcacctattttagaaaatagtatgttccttttttgagaagagagcatattaagtctcagcacacattaaattatttgccattaacttagtggggtatgctacaaattcttattgaaataaatctttacctttttaatagtggtcttattatatggggatgaatattctttcagattatcaagggaaattgctgttatctgggttaatctgacaattcacagattagaaaagaacaaatgaaatctagagaaatgtattcagttgctcaagtttaactggttagtaacgtggtgattattaaactcacttattttcaagttgaaaagcaagatataaatggattttgtcattatgaaaaataaaaatgagtaagtgatgtgttagagtaaggtagacatgagagagcaggcacaggacttcattgggaaaattataaagtatctactgaattggctggttatcttagttaaatgatgttatatactaggattaaaatttttaatttccctaatattggtttgacagttttataacaaactataatgtgtcaaaacccattactgcattttgatataccatctgatttttctcacagtgtattttg

SEQ ID NO: 106217 - DNA, 232 bp, Homo sapiens
taaatactcaagctggtcttgaactcttgggctcaagtgtccctcctgccttggcctcccaaagtgctgggattacagacatgagccaccactccctgcctatgttgttgttattgtttattcttttcattttattgaaaatttcaaacatcattcttgacccatgtttggaatgggaaattgcccagtgaaggagtgaggatgttaaatctatcttcctggttggaactat

SEQ ID NO: 106218 - DNA, 472 bp, Homo sapiens
caaaacaattctgtgctgagtttgagttggaaaagaaaagtcagaagttgaaatttagactacatacttaagaaaacacccttcaatggtagacttagaggcgattttgaaacctaatttcattcagctacaatctcttttgtagtactcttagcaaatcaacttctgtttgaatatttctagtgaaagccactttttataacaacagcaggaaatgaaatttggaaatacaatttgatgcttgcagctgccgaaaaagagattggctatagaaatcataagaaaattcagggtgttatttgtagatttttatctgattttgaaatgtctaaataagtgaatttttctgtgtctcccatataatgaaatgtcatgtgaataattgagaaataatgtctagcttggaaataaatgtaagaaccagaatgctcttcacaggtttttacagctcggaccaaatattcgttatcct

SEQ ID NO: 106219 - DNA, 284 bp, Homo sapiens
ctaatataaatcctaagaactcagacacagtcgattgagaacagagcaattcccttttccctcgttttaaagaatcatgtacataaaaggtttgaacactttgaactttgaataagtttgaacacttcatgccttttggccactagcatgctgttattttatgtcgcaagacgagcaacaatgaggcatccacagctcccaggcgtcaagactgaaggacactctgcctctcccttagggtttgagatctctgagtcagggaacactgagtgaaagcaaagctg

SEQ ID NO: 106220 - DNA, 541 bp, Homo sapiens
aggattgtcaaagccaatctgaattcaatgctttttatgtgctagatgctgtgcttggcactctgtgttgtatctcatttaatcttacatctggatgctacagtacaattgtttgtgaacggtagccagttaagttcattgactcctaggttagtcttgtacactgggatagaagaaaaaggagaatatatccttaaccttagggtcatatggtggaagaatctctgatggcttccagtaaccaagtttactttatggaaaagaggaataattgcttttttctaaaaggtggtactattcagtgacctggtgaaaattcctaggcttctgctattctatctcttttgggtataaatgactcaaatactcatgtgttcattaatgatgggtaagacctcagatattgggcttgcattgctggaatgtgttcaaaccgctatgtactgcccactcaactgttaattcactctcaacatctctgattctctggttccatatttgattatgtgtgttagatccagggcttatctatgacaactta

SEQ ID NO: 106221 - DNA, 392 bp, Homo sapiens
attccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatcccacagacacatcctgtactttcctacctcccctttggctgtgatcccctctactcaaaacaaacactcttccctatcttcattgcattttgttgaaatcccatggctcttcatagctctcctcagatgcaggcccacccccacccgtgctgtttcctccttgtctcatcctgcctgt

SEQ ID NO: 106222 - DNA, 449 bp, Homo sapiens
aagaaagggagagctgacatttatgaagtgcctattatatgccagttagtgtatgaggtaccttctgtgcattttttcatctgattctcctacaacttcttgaggatgttatggttttgtgaggttaacttacccatgaccaaactccgactttctctggcacccaaacccttccatgccatcatcttgcatgcttgtttctcatggcattcggatttatgtatttttatttttatttatttattttgagatggagtttgccctccagcctgggtggcaaagctagactccatctcaaaatagataaataaataaaaatacatttatgtctggtattacaaattcatctcacgtaccactcctggctcatgtactgtttatactaatctttgacctatagcagtggttctccacagtagcattatattagactcatgtgggaagatata

SEQ ID NO: 106223 - DNA, 318 bp, Homo sapiens
gagaatagcttgaacccaggaggcaggggttgcagtgagccaagatcacgtcactgcactccagcctgggagacaaagcgagagtccgtctcaaaaaaataaaaaataagaaataaaaaatcctgttgctgccatgcaaactgccacaaactaggtggcttaacacaacagaaatgtattcctttacagttctgaagtccggaagtccaaaatcaaggcgtcggcaggaccgcactcaccaaaaactgtaggggagactccttccttgcctcttccagcttctggtagccccaagcattcctccgcttctggctgcat

SEQ ID NO: 106224 - DNA, 413 bp, Homo sapiens
gtatttttactggagatggggctttgccatgttggtcaggctgggcttgaactcctgacatcaggtgatccacccatctcggactcccaaactgctggtattacagataggagccactgtgcccggcctcctactatttgttataggagcttttgccaaacatacaacatttctgaagatattaatctttgtttgcttgatgtttttgtatcttactattatctgtgtttatattttctttgtgcacaatctgaatattctttttatgatatgtaagtatttgtcatgtaccctttaattttcaagcagtttaaacctatattttttttaatctagaaggcttctaatttgtttgaatagaatatgcataactacttaatagaatgcttgccctatcagtatagttaatagaa

SEQ ID NO: 106225 - DNA, 565 bp, Homo sapiens
caacaggctcttgggcagacgccaaaggttctttcttattattactgctactattgaaagtcttctgtttaaatgtagggatgctttttcctcgagttgtatgatagtgtggcttgggtttttttttccctcctttgtttgttttggactttttaaaaaacaaactttacatttgcattgataattatgttattattaatgacaaaatgattcagtatggggactacttatcaaaggtgccagttctttcacatttaagtgacattcaatttagatttacaaaacacccagaaacaattcctatttctccagagaagttgagagaaaaattcaaagggattgaatcctaaaacacctacacttaaccatttttatttacatgctattattacaaaacaaacaagcaacaatattagatcaaaaaactggatttactgacttattgcttgtgcagagagttctgccttccaagcaacataactgacaagcaactattttaaaaagtatgtataccaaatgaaaaattaaaatcatactaaatgtttacaaatgtttttataatttt

SEQ ID NO: 106226 - DNA, 301 bp, Homo sapiens
ggagcgtctcactgtgttgcccaggctgatcttaaactcctggcctcaagtcatcatcctgccttggcctcccagggtgctgggattataggtgtgagtgagctgctgtgcccagcctcttttcaattttttgaggacctgtcctacttttttccagagcagctgcatcagacagtgcatgagagttcccatagcttcatatcttggccagtacttgttatttcctgggttaaaaaacaatattagccatcctctgcagtgagccctgttctcatcactgcacttgcctgagcaacactgt

SEQ ID NO: 106227 - DNA, 306 bp, Homo sapiens
tctaagcgaaattatggagatatggcagtagatgaaatccttgctagaccttttctgcttttattgctaaatctctctcattcacataatcactatgatgccaataatttgttgttaacatttgcagaagcatttaaattgtaaaggagtatcctagctccaaattgacctagagattcaatgcaatcctgatgaaaatttccaaaaggctttttttgtcaaaactgacaagctgattctgaaagttatatggaaatgcaaataacctagagttgccaaagcaatttcttaaaaagaacaaagttg

SEQ ID NO: 106228 - DNA, 365 bp, Homo sapiens
ctctttcttgcaccctcaggactcaagagtgaccctttttcaagggcttttgggacctctgttcactgactgggagaagaaaacacaacaccaaggtgaaggcccaagggcaaatgtaaatttgacctgggttctgctccaacagacttcttgtcatttagcagcactataaattttaatatgattcttatttcaactcagtggcttacttttaatcttcaatcttcggaagatattgatcatattcatcaggtcatagatgtgtcctggctgccaccatcaaggcttttgtagagtagcatactcagttttggcttaaatccttagttattttattctttatgaaaatcatttctaattttcat

SEQ ID NO: 106229 - DNA, 354 bp, Homo sapiens
gtgctgactacatgccaggcactgttgcaagtactttgtttaagttaactcattgatcctgaccacagccctttgaggcatgtactacaaaaatccccattttgcagatgtggaaactgagacacagttaagacacttgcccaaagtcacccagccagtaaacgtgagatccagcgtttgcagtcaagcagattgcctggtcccttagctctgcggacccagagccagatcttccagtgctgatgctgcgcctcattagcaggataatgcgggaaatttacttaaaccatctccacttttgtttccttatctgtaaaaacaggcagagttgttatagtaattaaatggaatacc

SEQ ID NO: 106230 - DNA, 240 bp, Homo sapiens
attatttaataactgcctcctcctcagagcctctgagctgcacgacgtaggactctgcccatgtctgtcatagtcactgatgcatctcagtgtttagcaagtccctaatacacagtaagtgttcaaaaaataattgttggatacatgagtaataaatgctactaggatgtgccaggcattgggctacatataccatctctaatctcacaaaaacactacgagggatggaatacaagtctc

SEQ ID NO: 106231 - DNA, 105 bp, Homo sapiens
tgctggaattacaggcatgagccactgtgctcagccatgattccatttttatatgaaatgcctcagacttaagcagggagaacaaagggagagggtggtttgtac

SEQ ID NO: 106232 - DNA, 458 bp, Homo sapiens
atagctacttcagaatcaacctccatcccgtcgctatttagagacttcttttttgaaatagaaagtgacaaaaagtcccccactttaaatgaaacctaaacatgtttaactctgtctgtacaaagaacctgacaaaaataatgtactcatttgaccttatatgataaatatgtgcttccattccatgttggtttgatggtactgttcatctaataaatacttatggagtattggacaaatgtcaggaactagattgggtattaagaatataaggaaaaaacaggatattgtcactgccagtgaaagactggctttataattggaaaggcaaacaattataggactttgtactaagagctttaaccttactatgccctggaattcttctaagtgatttaagtatattaacccaataattctcccaacaacttttcacatggttgctattattatccccc

SEQ ID NO: 106233 - DNA, 414 bp, Homo sapiens
ccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatccaggcaaatcttgcctgtgatacaggtggtgaagctactggatagaactggagcatctaactggtgtgagatggtatctcattgtggttttgatttgcatttctct

SEQ ID NO: 106234 - DNA, 363 bp, Homo sapiens
cttgaaatacagcaaatgcatcatcaatgtacacacacaggtatgtaaagctctttggctctagagtcaggagcctctctgcactcccagttcagaaacttatttggaccaagttacttaacctcttttctttcctcaaccttaaaatgtaaaggatatgaattagccctcaaaggcttattgaaaggattgtataggataatctataaaagtagtactttgtcacagtgatcttgatgaatgctgtcaagataccaatctcctccccacaaagaggacaacctctctgcacctactctccatgtggtttcacagccttcagcaggtatccatatatgaaggaataccaatactccacttaag

SEQ ID NO: 106235 - DNA, 357 bp, Homo sapiens
tccacttctcccaaggcagcctttcttcacttgcctcagccacctaatctctgtcccaccagttttggggttttccttactccatgcgtttacctttccacacttgcacatgcacacagcaccgcatgaaaactcctaggaatctctccttcaacatggcttaatagtccttcttacctaatttcccagtgacctctgactcacagttacacaaaggaaatggacgtacacctggagcccagctgacttgggctaaggttggtcatggctctaggtttggtttaccttattggctagaagacagtagaggcccaggcactgtgtgctttatggatcgtctttctaatttacttgaac

SEQ ID NO: 106236 - DNA, 175 bp, Homo sapiens
ggagccaaggggcaggtaaagaggctctgtagactcagtcagtgatgtctctaccgaggatgaaaaattcgatgtgacctttggggttgtggcaaagataatgacactatccacctcataggaaggaggcaatagctaaattagttcatttatgtgaacaccacttaggacagag

SEQ ID NO: 106237 - DNA, 456 bp, Homo sapiens
aggagagagtagggaaacggctggactttcttggagtcactgtgcttcccaccaactttgatgtggagacccccaagcctttccaaggtaatatatctctgggaaatagggctcccttttacaaatgctggctttatccctctactaaggagctgtgatgggctgctttgggggcctgaggagttaggggagagagggcaaagtgagcttccagtgagacgaaattcattgttgatgtggtgctgcttggaggatgtgaggttttcttaagcaactccttattttgtagcccacccaaaacttttgtaacagaagagagctaaagttaaactgcacccaaagagtccattgttggtgtgttgaaatacttaaaaaaaaaaattcaaaaacactaggtaatagtaacaacaaaccctttcaccggatcactcatctgcttctgaacatcaactcata

SEQ ID NO: 106238 - DNA, 269 bp, Homo sapiens
cagaagttcattattttctaacttaggagcacagaactgtatactgttcttcaccttccttaattttgaaattttttataaaggcgtggtcttcttatgttgtctaggctggtctggaattcctgggctcaagcagtcctccagcctctgcctcctaaattgcagggattacatgagtgagctaccttgcccatccctgcaccttcctttttctcttaagaagtctcagatcatcccaagtcagcatacagacctgcctcaatctttcc

SEQ ID NO: 106239 - DNA, 564 bp, Homo sapiens
agcctggacaacatggtgaaaccccgtctccacacacaccgtaatttttttaacttagccaggcatgatggcttgagcctatgaccactcaggatgctcaggtggcagtatccgcttgagcctgggaggtcaagtatgcagtgagccatgatggtaccactgcattccagcctgtgcgacagagcgagacctggcccctccccaaaaaagttttaatataaattacaggatatttttcattcgaaattgtgtacatatgaaatctatgagttataactgaacttccttaagaagtttgatagccttagggagtcttatgtttaggtcacatatggaattatcatctttactttgcagttatacagtgcatatacataagcactggttctttctgcagtaaccttttattcaagttatcaataaacttttgcttaatcatgctatctgttaaactgtaaaaataataacttagtaatagttcattatatctagaagtcacagttggctgtccagccctaaatgacctaggagacattttaccattgctgtgctaaggggtggggg

SEQ ID NO: 106240 - DNA, 501 bp, Homo sapiens
ctcctagcccttctgaagctgcagttcttctctcacaccgtgtattgccctatgcggatacctctcatacagaccctccactgggccgttcaagtccacgtacttatgggttcaccagctagttagtgcccccagcagggatacagagatggtttagtcacagtccctgcttgcaaggagctcacagtctagtgaggacatcacacaaagaaatggacagtgacgaccacacgagagactcctccagtgatgggtgcacgataatctggggcagatctggggtggggttaggtacaggctgctcagaggaagtgattctcaaactgagtcttaatgaggccaggaggctgagggctggaattttgggttggcatatttatagaccctgaggctgcaatggggcaagtttgggaaatcccaactctgtcatgatgactagaacaaagagtaagaggtgagaggggccagaagtaaggcttaaaacactaagagccacaaaaa

SEQ ID NO: 106241 - DNA, 499 bp, Homo sapiens
cgtggacttgaacggcccagtggagggtctgtatgagaggtatccgcatagggcaatacacggtgtgagagaagaactgcagcttcagaagggctaggaggccaggttctcaccagctagttagtgcccccagcagggatacagagatggtttagtcacagtccctgcttgcaaggagctcacagtctagtgaggacatcacacaaagaaatggacagtgacgaccacacgagagactcctccagtgatgggtgcacgataatctggggcagatctggggtggggttaggtacaggctgctcagaggaagtgattctcaaactgagtcttaatgaggccaggaggctgagggctggaattttgggttggcatatttatagaccctgaggctgcaatggggcaagtttgggaaatcccaactctgtcatgatgactagaacaaagagtaagaggtgagaggggccagaagtaaggcttaaaacactaagagccacaaaaa

SEQ ID NO: 106242 - DNA, 461 bp, Homo sapiens
ttgctgagatgtggattctaaccctgcacgtctgaagccggcccaagaatccgcatttctcacaggttcccggtggtgcccctgccactcatccccaggccacacttcagcccacgagggcctaggcttccgggggactgtctcccacccccacccttaacttaggtgaccattctctcagtgggactcacccgggtctggtgcacagctaggttccaccacatttgggttttttgagatggtgcaatgaaaatggtgactacggtagggtacgaggaagaagacagacctctgggttcacttttcaacttggcatttgtccttttcttccttatccacctcttggcaaaacatctaaaccaattcatctcaaaggagccaggctggggcagtacactctgaaagtgtccactatttagagtccttaacggggaggggctgccacgcttccttcccgtaag

SEQ ID NO: 106243 - DNA, 147 bp, Homo sapiens
acagtagctcttgatggaacattatttttaaaatctggagtgatctctggagggtcaagtgacttaaaatacaaggctagatgctgggatgagaaagagttaaagaatctaagagacagacgaagccagaaaatccaagagctaaag

SEQ ID NO: 106244 - DNA, 652 bp, Homo sapiens
tttacctacaactgtcttggtaaattctttttactgcctgcatgacactggccccagatagttgccactcaaaatactcctcttctttatccctttaaatattggtgtgtcttggccaggtgtggtggctcacgcctgtaatcccagcactttgggaggctgaggcgggcagatcacctgaggtcatgagttccaggtcagcctggccaacatggtgaaaccccatctctactaaaaatacaaaaattagccaggcatggtggcaggcgcctgtaatcccagctagttgggaggctgaggcaggagaatcgcttgaacctgggaggcggagtttgcagtgagctgatatcccgccattgcactcccacctgggggacaagagcaagactttgtctttttaaaaaaaaaaaaaaaatttttttgtctgtcttgaggcccctgcttctcttctagccttttctttggttactctgccactgttttcattgtgttttctccctctgtgaccctgtttaaaatccaaggtttcaactactctcagtttggtgttctagatttccagttccactggtgtaactatccattggacactttttgtccgcccatgggcataacatatttattatgtatgaaacagaactttttctttcca

SEQ ID NO: 106245 - DNA, 456 bp, Homo sapiens
gatcctaagaacagtgggcactgaagttgcctgtctctatgtcaggttacagctcaagctgtgtatatgctgcagacgcacaagctgaatttaagagaatccgttctaaaacattacttcctatttagacacatgcttaaagttatttccttttaaaccttaggcagatggtgaaatattcctgctgtattgtctcacaatgcataacaaaacttttcacgtattttcagatagttgagaatgtttccatatgtctggcatgcctgtaatccagcactttgagaggtggaaacaggagaatcacttaagcccaggagttcaaaatcagcctaggcaacaaaaggagacccccatctctacaaaaaaattaagaaattagctgggtatggtggtacaagactgtggtcccagctactcgggagttcgaggtgagaggattgcttgagcctacgaggt

SEQ ID NO: 106246 - DNA, 468 bp, Homo sapiens
ctcccacacccacctggagatgccgtgctctgagatccctcaaagccactgagggactcaggaagatcctgatcatggtactggctacacaggtgtgcttaatctgtgaaacttcatcaagctgaacctgggatgcacatgtttttttgtcttacggcttgccacaataaaaggtttctttaacatgcctccctttgagtggcagatgtcctatatggggtaggaaaaactattttaaagatcaaaaccttaacctaatcctaaccctaaataaagatcaaaactattataaagatcaaatccttgaaaggaaggccctgcctaggccaccaggctggtaatggctgagctggaattagggcccaaatcagacccccttcccatagtcctggagtcacactgtttccagggaacagccctcactgaaaagtatctcattacaggacgtcggataatcagagacagcgt

SEQ ID NO: 106247 - DNA, 712 bp, Homo sapiens
atattcctatggtgttgcactagcttgtagaaatcattaacagacccaacacaccaaagacattgttagagaatacagcaataacgattggtcgtcttggttacgtgtgtcttcaagaggtggcccccatgctacagcagtatgaagaccctggtgcacctttctgagaaacataagagacaatgaggaaaaggattcagcattccgtggaatttgtaccatgatcattgtgaatcccagtagtgtaatccaagattttatatttttttgtgatgctgttgcatcatggattaacccaaaagatgatctcagagacacattcggtgtaagatccttcatggatttaaaaatcaagtaggcgataaaaattggaggcatttctctgaccagtttcctcttcccttaaaaagagcgtcttgcagctgtttatggtgtttaatacacttaagctgcagtcccaaaattaggggtccttcagtcttggagactatgagggagcctctgcacccagggaaaatactaccctttacggggggaagggtaaaccggtagggaatacactacaatctcaaccctactggaaggggcaggagggaggtgttgctgtcactgtattaggttgatgttgggaaacgttttaacatgtggagcctttgtgggttgaaatatgtctccagctacaactctgcactggatctgaagaagcaaaaaa

SEQ ID NO: 106248 - DNA, 132 bp, Homo sapiens
cccgtctgctgtcctcagagcacatccagagcctgcccactctcctcaccatcatctcgtgatggggttactgaggagcctcccaaaaggtttcctgccttctttcctgcatcttactgtcagctttcaata

SEQ ID NO: 106249 - DNA, 389 bp, Homo sapiens
caggaatatatatgttgcacttcagaggataaaagtacttcattttcactctcttcttccccttcccctcattgattttatgttggaataagttcagtaccagcagaaaatactaatttgcaaagacagtgatttaagtgtctctccagacttcttgttggtttagtaaatccacataacactttagagtggaaataacttgaatgcttgcccagaatggcagacatgtgctgttgccagaaagagcagtcgactggggtagagggaaacggaggtttagccatgttttcgtgacaagtttgctgtatggcatcaagaaggtaattaaaacctctatgccttacacaaaaaacagaccccaggagtgtggtggggtacgttaggggatt

SEQ ID NO: 106250 - DNA, 277 bp, Homo sapiens
cgcagcctgattctgcctccctaaatgatacataggtatgatgttgctcactgtttttgaactttcaataattgattggaggctccatgttgacttctgcagcttttctgtcttcctgttgtttgagttgcagccacttggttttcattaccgtgtagtattccatcccatgatgtggctctcctgtggtttatccaggctcctatagatgggcatttaggctgtttctcattcacaaccacagcacatgctgtgtgggacttccatattcatgtct

SEQ ID NO: 106251 - DNA, 395 bp, Homo sapiens
tgcgtctcccaagtggcaccctcactctccttccatttagctgaagcaaggaggtgaaacctaaattttttaagcctggtgttcattgttctgatggaggaggagaactttaaaggaggctttccaggattcctttggccaaccttccccagatttccttcaccacgccatgcctttcctttgttccagtagagccctttttactgatggagttaactggccaacagtgaagcacagtcgtgtcctctcacttcctcccagccctgggaaccacagtgcactaaggaatcctgaccatctctccatgtctgagtcacagtggtggtgggaacagcacaactttccacagcttgttcccttggcagtctccttactccctccctccagattagaag

SEQ ID NO: 106252 - DNA, 523 bp, Homo sapiens
tgagcctcccgcctcagcctcccaaagtgctgggattacaggactgagccaccgcgcccggcccgtgttttgttttgttgttcaacagggtggaacataatgtctaaacctgggccctacctacctggtgctcaaaagtggaatgaccgtccctagccaacccttcagaaaggacagagagctactcaacggactgctgtactcttaaggactgggaaccggaaccgtgggtgagtgggactgaatcacagactaagcgttttccacgcttcgccgacgtgctgagtgccaagttataaagacaggaacatccaagctgctctcctgggctgacacggacgcgaggggacctacagtggccttgggcccagcaggcagcgactgcaacgtgactgcccagagtccagcccctggggcccagatctacagaaccgaccagacgtgatagccctttggctggggctgcagtcccacgatccacacaacgaccctggctccgcagacgcgccaaccacccacggag

SEQ ID NO: 106253 - DNA, 372 bp, Homo sapiens
gaattcagggcttttcgggagaacctctcttcttacacatcagtggagtactcactgataacactacgcttaatagtaatgttgccattattagtgttacgacccactgatatagagacctatttgacaactaacaggactttcttaaaagtccaaaaaaggatctgctttgataattctgctaggagatccaagtgggtgggtggatctgctagcaccactcctcaagtgtttcaatgttcagtctggggtagatccaattagcagagaagaatttttatgcaatggcttggactagagtttggaatttggcagtcatcactggaaaaatgaatttctgcctgttctgaatcaaaacaaaacaagccatgt

SEQ ID NO: 106254 - DNA, 169 bp, Homo sapiens
tatattagggagggggccttaggtgatgcagcggtcaagagttgaaactcatgattatggtatcttttccttctaatctacagggtgatgttgatccttttccatccggtgtccaggcactctgttgagagccaacgataagatctgcagcttgtggctctttcttttc

SEQ ID NO: 106255 - DNA, 196 bp, Homo sapiens
tcttccatgaacagtatagtttgaaatgtacagtgactagaaacaatttgcttgccataatcaatgtatgttagctcctaccctagtcacagcaccatattgggaagtttagcaaaatttacacaagatagttcttttatcagaaagcataaaataaaccatttgtatcaaaggaaggaatttagagacaatccag

SEQ ID NO: 106256 - DNA, 443 bp, Homo sapiens
gtgtccacagtgaggaggtagggggtcacaggtcaaggccgtggccgcagtgaggaggtaggggccacagcagcacccttttgtggagcagcaaagcccccctggagaccctggggtgccccaccctgtagtagggtgcttttggggagtgggtttgacgcagtagcacacagggcacccaggagccctgaatgggcatctcagtcatgcggtcactgttctgtccttgtatgacagagctggccagaggcctcattgctaaagatcggtctctcctaaaacttcctccgagaggaagatgcggagtgaagttgggtcaggttttggagaaggagcgtctgcaccacctggcccttgttaaatgcagtctcaggctggcctgggagccactcagaccgtccacaggcaagatccagaggctgctgtctgcacaagcttctctc

SEQ ID NO: 106257 - DNA, 652 bp, Homo sapiens
cggaattcttattatgttgaccacgcgtcgcagatttacaagatatggatttgtaaacctgtttaacatgaaccagtcctctaggactggttcatgttaaacagatttacaagatatggatttgtaaacctcaattccagtttaataatagtagaaaatattcccttcctagtgattgttgataatagttttttttattttaaaattctataatttcaaggattgaagagatttacactcatatatatctgatgtcactaagatttagttcaggttacttagaaagcattgggcaatgttttgtaacttttgggactttttccaaagggctggagaatataggaaaagccgtatacacgaagagtttcataaaagcattgttataagaacccatatttggaagtaacttaaatatccaacagtagggagatgtttaaataaattatggtataatcaatagttaaaatattgtacagttataatgacaatttagaaactactcacaactctgaagaatatttaaaaagtaggataaaaaatgtgtgtgaactattgattggaaccttacaaaaatgtatgtatatgaaaaagtctggaagagaatatacaaaagtgataatagttatgttacagtagtgagatatggagggct

SEQ ID NO: 106258 - DNA, 500 bp, Homo sapiens
ggtacactccctgttgttcaaaggtttatcattatgaaaagaccattctaaccagagcctactgagataaaagctgctgccccatcctgtgccggggcatgtgagtgctatttcagtggctgtgtccacagctctgaaaatctataccttggatgaaagcccaactagagaatggaacattctcttatatatattctctgaaaaactgtcacatatgctcagacatgaaagaacagaaaggctgaccctggcagctccccacgctgcagaatttcaaaaatgcctgaggcctcactaaaatgaactgtctgaacaaaaggaagtagaaagagtgaaaggagacagaatgttggccgatatggttgcctctcctccctctatccccagcctccatccctccagatgtttttgctgagcttctgtcagccttcttggcttaccctttagtccctgccccagggagctgaattcaagtaagtacagcaaatgtggcacaaatc

SEQ ID NO: 106259 - DNA, 1793 bp, Homo sapiens
  misc_feature (923)..(923): n is a, c, g, or t
  misc_feature (1034)..(1034): n is a, c, g, or t
aagtcccctatacccaaatatggtttaggcttgattgaaaacttagcttgggcatttttctttaaacataacgttttgtttagcaaaaggaaacttgttcttttttggttcatggttttcttactgaagattctactacttatttgaggctaaactgtagctagtatctttgagcttttcttgaaggagtttgaagttcactattagtgatttgggcttttggaccatgtctataagtgacatgggaccggctgtcactgacaggacccttccagggaggctgtgtaacacccacgggcccctgacagtaactctgtgcagtgagtgggtgggggcctctcacagtggctgggaaccagccagagcagggatgagggagcagactgtctgggccccagggcagactgaaaaggatggagagaaaccccaggatggggtcctcctccttatgtgtttttaagttgatgtttggcttggctgggtttccgtaataaaaatccttggagtgcagggctagtcctgctggccccagcagaaagtcgaggacttcctagatgtctgtggtgcaacagggcaggatggggccgtgttagcgctcccaggagacattaggaggcacaggcatgggtgggtgtcatccttttcctcaactgtatctgaagactccacccaacccttcaagaagatggaaatgcagttgcccagaaaccgtacttctcagtggtgttttttgatgtggcatctgatgtgcactgatctgtgtcttttgttctgttctgtttttctgtcctgcctcgctcgaaaggaccgcaagtctcagctgctacaaaatcaaagacagcaagttgcttaggagcagcacagccttttctgggattgagaccagagaatgcttccctcggggttcttaaggggcccccgtntctgtggtcagctcagtatgtggggctacaggaggcactcagtggagacaacagcctagggggagatgaaccccagagggagctggctgagccttgggctgagcagccacngggagagaatccagaggacgtagagagagaaacagcctcctgcagccagtgtgggaataacgtaggggatttcacttacttcccacccttggaattgtagcaagcccagcatcacctgagcctgagctctgccctttgtcactggggcaggagccagtagcgagcatgctgggtgctgtggctgtcagggcgctcccctcccctgggcctgctgtagcaggaatctggggcttctgacgcagtgcctgcaaggagcaaacccaggccttaggagtgatcaaactcactacagtcctgacagaaagtccccaacaagcaggaaccgggatgtcagtgacatcccccagccatgctccggggcctgcctctgagtagcacttaggctcagggctgcctgcctggcttggccccagccccttcaatggtgaccagatgtctacccaggtcctctgcaagactgactgctgtgagaaccctgcactctgtggggagggaccccccaagggcacctggaagcaggcatgggtgttgaggtacatctgggctcagaatgggagatggattttccccccattcccccagccactctctgtggcaggcttccaaagaaaccctctcagaaacacacaattatcaagctgtgacaactgcttgaggtgaggctcacctggaccagtgaggttgtttgtttgttttgagacgaagtctcgctctgtcgccactgcactccagcctgggcacagagcgagactccatctc

SEQ ID NO: 106260 - DNA, 499 bp, Homo sapiens
ggaggtgatatccatattctacaaacgaggaagctgaagcactacgtaagttgttcagggtcacgcagctagtacgagaaagtgctgggaggaaatctaagaagctgtggacctgtcatcatcctagttatgatttagtgtcaggtcaggcatcctcttgagtgctgaaaaaaatctttgcttctttgggattgacagtcttttttgctggcacctgagatgggccttgctaaaggacatctgtttgtcttcaatatcattgccacgttctgcagttccgttaagtgaccctgtgttgagcagtttctgtgggcaaggtactgttgctggagtggtcactaggagatacagaaatgaacaagaccatcctgccctcagcttacagtttaatcaggaagaaagattaaactgtaagctgaaaatgtacacaagaaatgtacacaagaaaatgcacaaaagaaaatgcagtacacaagaaaatgcagtacatactgagtgt

SEQ ID NO: 106261 - DNA, 741 bp, Homo sapiens
ttcacagccacattttatcacatatacaaagataacctggtattaattctactgagtgtattccaaaaatcaaggtggaagtccttcctaaattatttgaaaacattattatcttggtagtaaaacctagtgaacccacaacaaaaaaggaaaattaccggtcactattcttggtgaaaattgaaacaaaaattcatgaagtactagcaagttgagttcataagcaaagcaaaaagttactttgccacaatcatgtaaacttcattgtatgaatgcaaagatgtttcatcatatacaagtaaataaatgtgattcaccatgtaaagataatttttaaaaaacaattatcacatgcagaaaaggcattcaagaaaatctaatattcatttataaaaacattctcaacaaactaagcactggagaaatatgcctgaaaataataagagccatccatgacaaatcctcagccaacatcatactgagcgggcaaaacctggatgaggtctccatcagaataaaaataaggctgggtgcggttgctcacgcctgtaatcccggctctttgggaggctgaggtgggtggatcacctgaggtcaggagttcaagaccagcctggccaacagggtgaaactctgtctgtactaaaaatacaaaaaattagcctgtcgtgctggcaggcatgtgtaatcccagctactcaggaggctgaggcaggagaatcacttgaatgtgggaggcag

SEQ ID NO: 106262 - DNA, 446 bp, Homo sapiens
ctgatagtgggagccctaaatactatgtataaattctgcccacatctctggctaacccctgaagcttgcattcacaggggcagattcaaaagagcttgcaattaaggttgacagaactgagatttgaggagccataatgcctaggcagtacccactcatggcttgactccattttctccagtgagagtgcacgagaattggtaattagactggctgtgtggcattgttccttatgacaccaaactaaaacagagatgttcccaacattccctgataatgaaatactgaaggattgatcttttaaaggacacagtcagcagtcttgtcatttcagtggaattagacatgttaattccaaagaagtcttctatattgttggctaccttagcattttatttccttagaataaactacttaactaaatatttaaaaagccaagttgtggg

SEQ ID NO: 106263 - DNA, 397 bp, Homo sapiens
tacaaatcctataatgggttatcaaattgatgatttatatgaatttctaaacctgtacccacgtaatgatattttgtagttagattttggagaaatgagaaacattaaagtatccaaggaggaggtgttttgaaaaatgaaggcattatgttttattttacgcttttaagattagtagaactataaaaactgatgaaagatttaaataataatgagatacattataactggggttgaagactgacagtcaagattcctgaattacagctctcactgatggcagcttattgaatagctagctgtttctgtattcctgggtatttttcattgttaaaatgtggtcagatctccattatctctgctaattataggaatcatgccattattattattatta

SEQ ID NO: 106264 - DNA, 195 bp, Homo sapiens
cctctccaagcatttaccattcagacttactacagaagatatgtcttcagtccaggttctaattatattttctttgtaaagcataaagaatttcaaagaaaaaaaatgtgtgagaaaacattgatactggacatagtcataacacttggtacttcctcaataacacacttgatagtaatttcctgcgtaatcgtc

SEQ ID NO: 106265 - DNA, 421 bp, Homo sapiens
ttttaaattacttccaaataatttatacaaaaggaaatttaactttgaaagttcctttcctatctagattaaaaacctgtgccattgaaagaaaaaaaaagttgtaggttacaactatagaattgaatttagctatcaccagacaattattctttaaaacaatcaacttagagaaaacttagttaactctttgaaaaactgtcataagtgttatcttaagcttgtcctcaccaggattgaatcatctctatcaaaatgtagagattaggcttgagcctgggaggtcaagacttcaatgaaccatgatggtgcctttgcactccagcctgagtgacagagcgagtgagaccctgtctcaaaataaaatagaaaaatgtagagatcaggtggatgcaacctaggttatcccatcataagtctt

SEQ ID NO: 106266 - DNA, 441 bp, Homo sapiens
agagcctctcctctgtggcttgtggctctgcatacccactgacacaaagaggaagggattattaacagtcttattttgaaagggtcttctgattcaagtgattatttttctttcctccctgattcacttatatctattttacgagtattaaagaggagatctctctaagacttatctttgacaaatgcaataaaacctttcaaaagtattaattggtgtgaagccctttagaaagtcatgccatttgttgcatttcctgcctttattgctatttctactaatcacctgggaaaaattactggtttttaaattcttaagtccagttctttctaagctgataaactttctcccagtaaattaaaaagaaaaggaaggtaaccttccgaggtagctcatgggagtggttgctaactcttaataattgaaaatgaaagttggttt

SEQ ID NO: 106267 - DNA, 744 bp, Homo sapiens
ggtcttgccaccaacacgtattttgaagtattgtttcaaaagtagacgcctgatttagagtacttgatttagacattcacggattcaaatgttgaattttgaaatacttccaatatatttccgtattgtattacatacagtgtctaccagctgactgttgttcattcattttggattacattttggctaacatgctaccactgacctaagatacttaagcaaaactgctgaaaaatgtttttaatgctttgtgtagtagatgctgatgttaaatttttttctccgatttgggaattttccccgaattttgggaaaagcatattaataaatgcattattttttcgttttaaaagaaaaattaatttctacatatcaccacctacctcagcagcagaatatcagggcagtacattttaaaataacggttggttaaaagatgcaagaaaaagttcatgggccttttgtttttgttgttttaactaagcaagagaaatgaaatcttgaaactgtctttggatttcttttgttttatattatcctatcggataatctgaatttatattttttatgcaatgtgagttttttaaaaacagttcttagggtagctgcattttagctataatattttttggtgcttgcagatattttaacagtcattcagtttttcacattcagatagtgaactttttgcctgagagtttgagtacattttaagatttcactggggtaaaatttgaatgtttg

SEQ ID NO: 106268 - DNA, 811 bp, Homo sapiens
cagcacccgggggtcaaggtggcacggctcacccgggacgaccagctgggcccccgggagctgaagaaataccgcctaatcaccaagcagggcatccttttggtccgattcaacgcgtccgcgctgctggccgggctgggcgcgcggctggcggcgctgcggacctctggcaccttctcgccgctgcccaccgaggccgtgtccgaggcaggcggcgacgtggcacgcctcctgctgtcaccctccgtgcagcgcgacgtgcttccaggcgggaccatcatccaggactggcagccctaccggcctagcgaaagcaacctgcgcctgctggcggccaagggcctggagtggcgcgtggacagccgcgcgcgcccgcgcgtgctcacgctgtgcacgcgccccttccccatcccgcacggaggggacggcacttggcgctatctcaacatcgacgccttcggtagcgacggcgcgcaggtgcagagccagctgctgtggcacctgcagcgccaggccccgcgcctcgttggcctcaacgtcatgtgccagctcttcctggagccccagctgtggtcacagctggctgacttctgccaggtcgggctgggactggagctggtgaagggttatactgaacagtacctgctggaggccgacatctgaggcctctcctctggcggggagggggaaaaagacccgcccccttccgcagtttccccagccagcctctttcctgccatttccgacgctgcgtctcctgggaagtcccctctgactcctgccctcctgcccttaccggcgcaggtccccc

SEQ ID NO: 106269 - DNA, 426 bp, Homo sapiens
tcgctgtttttgctcgtctctagaggttcccgctgtctcgggtacgtcataggtcatgacaagatcggacagcgacaaaatcatggcttaggatcgacaagaagttcaaaaacagctgcgagtctgttacttaaagtttgtgcgacagtgccctgagacctctagataatagatgtttgtttacatgacagaaagaggccaggacattgtgtctcacacgtttattccccgctctttgggaggcaggggcgggtggcatcacctgaggtcaggagttcaagaccagcctggccaacatggtgaaaccctgtctctactaaaaatacaaaattagccaggcatggtggcaggcgcctataatcccagctactcaggaggctgaggcaggagaatcgcttgaacccgggaggtggaggttgcagtgag

SEQ ID NO: 106270 - DNA, 445 bp, Homo sapiens
agagagggcactcatcatgagactacatcaaattccatgctgccatcacagtagaaagcaaaaccaggcagctaacgcccgctcacaccagccctagccagagggcaattgttcattcagttccagcaaccctggccacctggactaaagtgctctagagcattaaataaacttgaaaagcagcctaggacacaactgcagttcctaggcaagttctagttgtcagctgggctcgaagccaggagacatggggggcatgtgacctactgagactccagccagagcaattaagggagtgcttgcaccacccttcccctaaccacaggcaacacagctcgtgacccctttctttcacttgaggaaaggagagaagagtaatgaggactttgtcttgcatcttggttataagctcagccacagtaggatagggaaacagacaaggtca

SEQ ID NO: 106271 - DNA, 236 bp, Homo sapiens
ctggttgtgtcaaaggctggagacttagtgatgagtcaagttatcatgttcaatcctgtaaagctccaagttcccgaggagattatgtccttaaaacaagaaggtaaggacttgtttaaagcttgtccaacacttctgcccactgctaaaagctgaaccctcaaggaaaggtttatgctcaaagtcagtgcccataaagacatgcaaagactttttcccaaaatactgatgcagca

SEQ ID NO: 106272 - DNA, 250 bp, Homo sapiens
ctgggctctgcggtgagtggctgtgtttggggctgtgctggacagcaaggtcacgtactccaccctaggtggcatctctgcatcaccagaagagcaggggtcagaggaggaggaagaggcttggcaggctgagtattcccagccttgcctttcacaccaccactgccatagggagtcaggcccttcaccatctgggcctcagcgtctttgactgtagaaacaaaaatggaggcatgaaaagcctcattca

SEQ ID NO: 106273 - DNA, 131 bp, Homo sapiens
tagagagtgggtcggggggaggtctcactatgttacgcaggctggtcttgaaattcctgctgcaatcaatcttcctgccttgggctcccaatccttgaggtcttaagcctttaagaagaaatctctttact

SEQ ID NO: 106274 - DNA, 363 bp, Homo sapiens
ttttttaattttcaattacttgcagatcaatgcaaggtcctattgcacgcctgagcagtttgcaacttgcatggcatgagactcaccttatgagttcagcagcactcaaactggtctaaacacttgaacaagacagactagtccactgatcagggcttggatgtcatagcagtgtcaaattgctacaagggcttccaactgcttactctttgtttctgtatttttgtcattatacactagtaaacaagcagttctgggacctgaagcaatgctctgttattggccatcacaaatgtaaggttgaatttgccacatgcactgtctagtcaaggttaattattcctagacaactatgacttgcca

SEQ ID NO: 106275 - DNA, 435 bp, Homo sapiens
tagcccggtgtggtggcacacgcctgtggtcccagctacttgggaggctgaggcaggagaattgcttgaacccaggaggtggaggttgcagtgagccgagatcatgccactgcactccagcctgggctgcagagctggaccctgtctcaactaagatgagaatcgtgtactaaagaaaatttaataaataagtctctgaaatgttacagtcgaacagttttcagttttgtatattttaatttttatacttttttttgtcacaatcataaaaggttttaaaagattgtggagatgatggcttctgaggaaagtttaaaagttcctttaaatttgtgatgaaaatgtatttattggcaatctttgtcgtgtttttaaaattctttttgtaaattaaaaaatgtcccaattgaaacaataaaaaaatacagaagagtt

SEQ ID NO: 106276 - DNA, 411 bp, Homo sapiens
tagcaagtgcctgccatagttgatgaataggaggtttctagataactggaattcagcattctagcatgggctgttggtttcccacattctcctgttacccttttccttttctaataatttctttctacttcctggttctttgctccaccttaatcagcatccataatcatctgccttacccagtctgacaattagaggtcttttaagcaactcttctctggacatttacccttggctatttgggtccagaatccagcattctagtgttgctgtcacctactgcctattataccatcttttattccctagagtggatcctctactcatgagtattatatagaatttgtatatttagtgattttaaaatatttttatattttctaattataaaggtaatttgggtttacatag

SEQ ID NO: 106277 - DNA, 434 bp, Homo sapiens
ggcaaaggcactagactctggtgccttcttttccttcgttgtcttaagcccttcttttcctctgccctcatgccctcaccacttcactcttttgaaggtcataatgaacacaaggtcagagatcccttttttggcgccaagcaccctgggcttttttgagatggagtctcactgtgtcacccaggcagtggcgcgaatctgcccactgcagcctccatctccctggttgaagcaattttcctgtctcagcctcctgagtagctgggactacaggtgcaagccacgacacctggctaatttttctgtttttagtagagacggggtttcaccatgctgatcaggctggtctcaaactcctgacctcaaataatccacccaccttggcctcccaaagtgctaggattacaggtgtgagcccctgcgcctggcctttc

SEQ ID NO: 106278 - DNA, 348 bp, Homo sapiens
tgtagggacaaggtctcattatgttgcccagtctggtctcaaactcctgggttcaaacaattctcccaccttggccttccaaagtgctaggattacaggtatgagccaccacacctggcacctgtagctcttgacatccccttctaaggaaccatataactgctttgttctattcattgtctgctgtctgtctctctgggccagaacgtcccctccgtgaggtcagggaccttggcgttgctccctgtcatatctcaagtgcctagaacaaggccccgctgagtatgtgttcaaacagtgtttgatgaatgaatgtaaattcagccacatcactgccctggctgttgt

SEQ ID NO: 106279 - DNA, 115 bp, Homo sapiens
caaggatgaatttttggcttttggtttgaacagctgggtgaatggtattgtttgctgagatagggaatgctggaaaggaactggttgatgggagtggtgggtaatgaagagttcc

SEQ ID NO: 106280 - DNA, 339 bp, Homo sapiens
acccacacctggtgaacaaaacagataaccttaaattgggccatacactgagttacaaaataaaagactaaaatctagtattttcatgtaacagacatgcattaagtgcctatctaatgcaaaggaaacaatccaaaatgacaaccaaaccatagaaggtatataggttcacagtgttgaaaagaacactattaatttgaaaatgtattatgtttcatcataccttaattaatgaaattagttcatttgattgcttttagtcattctaatataacacgaacaatgctaatactaaaattattaatccaatatattcatttctatggctattttcttgat

SEQ ID NO: 106281 - DNA, 396 bp, Homo sapiens
aggaaggatttttttaaaagatacaaaagcagttacagcgaaagactgataaactatactaacatttggaacttctattcaagagtgatcaagaaagtgagaggataagtcataaattggaagaaaacatagcaacccatgtaactctcaaaggactatttcaaaataagtactcctatgaatcaatgagagaaaaatggaaaaatagtcaaaatacatgaaaaggcacgtcacagaaaaggaaaacagaatggtaattaaatagatgaaaaaattgaccaatctcattagttatcagggagatgcaaataaagaccacagtgagaggacattttatgtccactaggtcagcaaaaagtaaaaagcctgatgacaccatgtatttgaaaagatgta

SEQ ID NO: 106282 - DNA, 493 bp, Homo sapiens
gtgatttttatctgcattggatctactttaataaaccccacagcctgaatagcagctactagggtagtgccagtggatgtatatggagactgggctggaatggctgagtgtgtgggtgcgcagctgggagcagccatggcagtaagtagacagccagtaacttctgataaaagggagtatctgaaaactgaaaggccccataggaatgccaacaacatttcagaagttttcaacccaaattaaagacgaaaaaagtgaagtagatgatgcaataaagagttggcaaattcccagctgggcgcggtggctcacacctgtaatcccagcactttggaaggccaaggcgggcggatcacgagcatggtctatagaagaagaaagaattcatcatcatttctaggaatatccccaatcataatcctaagactccagctcaaaacaataactggcaactcttcaataattaattaaaggaaggcacaccctcaattca

SEQ ID NO: 106283 - DNA, 696 bp, Homo sapiens
agagtggaaggagactctgtccatctcacctcatcagctcttccctggctggttggaaaagaccaacccaaaagaggggtgatccaaggagtgagagacacttaccacaaaatgggaccctccccacagaatatagggcttttacctccttctctttctccatagaaaactacatttcctatactagttagagcacaagtagtatagggaatgtagggggtgaggactacattatacaggagtgatagtgatagatccttgtttctcctgatgaaatgttttcatgtacttttggtcagcctatcatgcttctatcatttgttttcctttgtgaagttccagggatatggaagtgggtaggtaacctcttgccaccattctttgttctgtggcaccttgtcatcatatttcaccttgaagtccttgtctcacattatagatcttcactttggtatgcacacaccaaagttagtgtgaggaagtagtcattgaagttattataggacgacattgttcatctgtggtggaagacaggattggtatgggaatggtgatgaaagctaggtgtttgtgagggtttgtaaccctcatggggcactaccacttcccaaaaaattgtctccattattaagaacattttgtttttatgtgtgtgtgtgtatgtgtgtgtgtgtgtttgagacacagtctcactct

SEQ ID NO: 106284 - DNA, 133 bp, Homo sapiens
tgggtggcactgacctgtccccagccgttagggagggagctgcactccgggctcaggtggggtgtggggtctcctggttttatccacacccccatccccactccatctcactgagaagccgccttgccacttc

SEQ ID NO: 106285 - DNA, 262 bp, Homo sapiens
ttatgagcggagtcatgcggttcccaagcactcagcatcctgctagacgcgccgcgcaccgacggaggggacatgggcagagcaatggtggccaggctcgggctggggctgctgctgctggcactgctccttaccattcccctgtattgtttacaaaacaggaacttcttgaatccatctctgtaaataaactcagctggactttttatcaatctctttatctctttctagatgacagtctaaggacacttatctaacaggt

SEQ ID NO: 106286 - DNA, 425 bp, Homo sapiens
cagcatgctgttccctctgggctgtaaaaggcacaggggactctggcctgcggaggccagaaaatgtatcgggaatcccaggaggacggcccgactggggcaaaagctccagcgttctggacaagtgctgagcaatgtgtgacccagacgtacagagaggattagcaggaggtagggactgcaggtagggcctgttatgtccatcattgcatgcgtccataccagggctgcaggccaagccctggaatcccagccctgggtctggcttggggaggagaaccttaaagccctcactgctcttcccctccccccgcccccaagtgtgactccagatggccagggtgtacaccacctttcggccactattgagtgtgccaagggggccgtgagaggccctcacacccttttgttgcaggtaaaaaaaa

SEQ ID NO: 106287 - DNA, 1042 bp, Homo sapiens
  misc_feature (781)..(781): n is a, c, g, or t
  misc_feature (891)..(891): n is a, c, g, or t
  misc_feature (979)..(979): n is a, c, g, or t
  misc_feature (984)..(984): n is a, c, g, or t
  misc_feature (990)..(990): n is a, c, g, or t
ctacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggcatccagacccaaactcagctggagccaattggggggcagcccgcagagccaatccccggacggcagggnttgggtgagcagtctctgaccctgaaagtgaccagcgccctgagccgcgatggcatctcctgtgaagcctccaaccccacgggaacaagcgcatgtcttccacttcggcncgtgaggcccagactcccaggctggagtggccgtcatggccgggccgtcagcgtgggctcctgctcccgtcggtgctgcttctactgngtgancgcaanggggcccctgtgccgcggggggaaaggggcccgccgcggaccaggtggcatc

SEQ ID NO: 106288 - DNA, 251 bp, Homo sapiens
aagccctggatagaaaactagccagtatttacagtcaaagtgactataatctgaaccaaacatgtaagtcatgggaaaaaataattttaataaaaccccacagtgatgagaataacattgttttctccatttctgcacaagctcacttttttctgtatttttaaatgtacacatgttatatatacataatgtatacataacatatatgataacccggttactgcagtcagcatggagacagcagtacacta

SEQ ID NO: 106289 - DNA, 362 bp, Homo sapiens
atgagcccaatgtctccaaaaggtaaaatcaaagaacaaagccacccttggggctggtctgaatggggtaccacgtcggggtggggcagaaggctggaaaccacaactttgctctccttcttccccaattcccccacccaacccccaaattaagaggagtactgcagtgctcaggaattcccaagagggtggcccttctcccagttgctcggtctgctaccgtccgtccgggacccggcgcgctccgcctcattgttccagcgcgccgcccgccgcccgccgccgggagcccgcgccctgcagagccagcgagttggcggctcccggggaggggggttggggcttggcctgctctagatccc

SEQ ID NO: 106290 - DNA, 421 bp, Homo sapiens
gcaatactaacaggagcataagagaatggcctaagttccagatgtagtctttcttgcctacattttgtgcagtaacccatttttcctctgctaattggaatcagtcacgtgggccagtagactaacctcttttgctgcctgttggtttaatgactaggtagaagtctctagttcagtggaaccattgttgtgtttactggtagaagcaatactcttttgtacactaagcctccaaaccagcagagcttagagttgttgggaggggaagcaaaaatagtgtgaatgagtttatgagaggaaaataaatctcaggacccccaaatcactaagtcaaagagaaaagtcaagctgggaacagcatccagcaaaactgcctcccattttattcctaaataagatagctacaaaaatttaaaaaaaa

SEQ ID NO: 106291 - DNA, 354 bp, Homo sapiens
ccatgctcatcttcccagtattattccagttttagtatatgtgctgcctaagcgagcatggaaattcattttagctgtaagtttgtgctgggcagattatccaataaaagtgcccttgtaatctaatagttctgaaatagccttgtgaatggcagatcccctgactgccctgtctgttctgcacccagcctgccagctttgccttttccactgatgtttttgtgggatgcagtggaccccagaagaacagtacctcagatttcaagcttgtgacccactagctcagcctggccaggttaaattggtgtcttaggttccctgtagaaagggtctgtgattgtcaacctggctgcg

SEQ ID NO: 106292 - DNA, 357 bp, Homo sapiens
aaaaaaatacaaatacatgccaaataatattgtttaataaacaacaacaactttttctataaattttttcggagcatcagttaatctatgctgctgtgttacagtagggtttggcattcctcactgtgtcattgaacatggaaagtatgggccactgttaaagtttggctgcctttaagtggtagtcagctactactgctggagaaatttagcatcatatattgtttacttgttaatatgcattaaatataatgagctaagtacttttaaaccacttttattcaatattgtgggggaaaatttagccccttccagaagaaagagatggtcagaaacagctgctttgtaaagttggca

SEQ ID NO: 106293 - DNA, 887 bp, Homo sapiens
tcatgaagacctgcgaaggcctagtgatcttgagggtcagttgattttgaggttctcagtagcaggagttggtgtattcttagctgcccaagaaccctccccagcatattgctatggcattcttgtcatttgtcctgaagaagggaagagacaggaccatgctgggggaccttatctatctaactcctgttgttgtctagtgcttagaataatacctggatcataataggtatttgataaatagttgttaaatggataagtaattgctgaaggtctacttttgcttgactagctcatgccttcaaagtctataactggactggatgactgttctcttctaaaataggattttgtgaattatttgagtctatttctctgactcagaagtctaagccgggataaactcttcctctcatagcataaattctaccagttccttaaaaatctgtatctttgggtctataactcgcactggccaggaccatttgtattccacgcctcctctcatgcctacactatgagatgatggcttacaaaggcctattgcccacttatacttctcaaagcagccattcagagaggtcagaatttaaagcagagattattttagtggggaggtggtgaggagggttaacaaaattgctgttttattggatctaacttgcttttcagaagcacgtgactggcatatttgggtcattaaatataaagacattctgcttatgaattatgccagcaagatgttttcagatcatacaaaaacaatgtgtgtggtgactgccaagtagtgtttttatgtgtatgtctgtacacaccacccactgatctatgcaaggcagtggtgctttgcactaaatgccacatcgttccttctgggatctcagaac

SEQ ID NO: 106294 - DNA, 682 bp, Homo sapiens
gactaattttcaatgtgaaaataaaatataaaaactgttcttagagttatttctaaacagtactaacatcagaatcgtcccaatcatcagaatgtctgttttttaaaagtcagatttatcaaatcaatcttcggccaacaactttttgagaatgatgtaaacatcacacataggaattccgcattttctaggatttgacattttcagctattgaaaattactatattttgtaaatggacgtaccgctactaaaaacagaatgcttgaaatagaatgtcttttgtttccaaagtcagtacactagagctatgtgaaaataatcataaaagtgaagatattttatggcagagttatgttggggcaaatgctgcagctgcaagcggtgctggcaaatattgtcggagcaagtgggaaaaggattaaagatgtttatatgctgattataatgatctaataaaggggggaaatgatgcaagagagagggaaaattgcaagagcaaagttactgaggtgaaggagattgtgacttggtgtactagtccatatctgggagcactgacaatttctccagggtcacaggaagaaggtatggggctgcagagtctttcattgaacagatatttacggaatgcttaatatgtaccagtagcattctaggcaatatgttggtaaacagcaacaa

SEQ ID NO: 106295 - DNA, 709 bp, Homo sapiens
ctccttgcagccactgggctagactgcccaaaagaccacaactcccatactattagagagaaagacctctagttccttttctctttgttgtatctgttccctttcttatatatcgagaactattatgaacacagtaacaacaatttcttccaagaatcttcacttggatttatagaaggaaaaaccactgggacatggatcagcttccactggtcttttgtatcttatgaaagccctgggtggcctttcagagatcagatctggtcattaatatccctacacttcagactgcaacaatggagggccattttttttttctctttcattcaggtataagtattcaattataaactgcattagtattattagtttttaatctccatgtgaccactctgtgttttataacccagattacctggattaattaaaaatttccacctcacaaatacatgtacaactagacttcaaaccacagacataatggaaaattcctctctaattgctttgcagctgctcattcttgctttgccttgcctcttacctatggggttccagagttatgagatcactcagggtgtggctctcaggttccatcttgtacgcttcttggtatgagtaaataacgtgggtagagtggttctatttacttgtaatgcaacttaggtcacctgtactttgcatctccttccacaaatctgcattagcctaa

SEQ ID NO: 106296 - DNA, 372 bp, Homo sapiens
agtatgggaacatggaagagtatgatattatacaaagtaaaggaagcagtggcatgcatgctataataacaactatggaaaatatgagtgcatcaggccaaggaccaaagggtgttttgcaaaaaataaaaaatagttgtctagggtagcaagttttctcaaaatgattcccaaaattgttgcatagtctttctatgaatgataaactaagaaagaagggaatgactttcttttctttgagaaatcctattttttccaaaaatgtattacaggttgttaaacgctactcggctgagtttcttaaaagattagcctgccccataagggttgtgatggcaggaattctggcttctatttctagccctgttgaca

SEQ ID NO: 106297 - DNA, 318 bp, Homo sapiens
tactacagcgaaataaacactttactttcatggaaaagtttatttaaatgatccaagatacaatctgagagaggaagttcagcaacctgtgctggcttggccagttcccttgccttcctgtagtcccatggcaaggatacatcagagcactcaacaataccgttgaatatgtcagtggagctgccctggctggcagacctggaaagcagcaatttgcattaggtggaactcatcaattttgagtggtcacttagccaccatctacaccagtggtgctcaactttgctgcatgttaagagtcacccgaggggcttttaa

SEQ ID NO: 106298 - DNA, 264 bp, Homo sapiens
tggaaagttgctagattgtaatctgtattgtattttaattctcgtttactctttccactccccccacccctcaccccatccatctttccattgtctagtaaatggtttgcagcagcgacagcacagtttagattccttcttcccctttcaactgtgttgtctgggctctacttggaagtctttcactcagtgatttttcctctctcctctttctggtgatgaatctgctattcaagtgacagtgtctttattctttgtgtcatt

SEQ ID NO: 106299 - DNA, 573 bp, Homo sapiens
agggagtgttcttgggttttgggggttttttttctttttttgttcttgaagtcagtggtttttagtatattcatagacttgtaaaactatcaccacaaatcaattctagaacattattcatcccctccaaaagaaactatagctatcacctcccaattctcttcttcctccagcccttggcaactactgtgctactttctggcactataagattgggctattctagatatttcatataaatatgacttttgtcttttgggactgattctttcacatagtacaatgttttcaaggtctccagctattttttttagggagaaaggaaagcgtattactttgtatattatgcctctgcaacaattccaaggtccttgagaaaatacactaggattttgctttttacaagagagcttgaaatcaagggacatttgagagtagtaaactgggcctgggcatggtggctcctgcctggaatcccagcactttgggaggccaaggcaggtggatcacgtgagcccacaagttcaagaccaggctgggaaacatggcaaaaccctgtcctgtctctaccaa

SEQ ID NO: 106300 - DNA, 377 bp, Homo sapiens
ttaggcaagtaagagagtgacatgagcataagtccattttaggaagaataaactggaaggaatacaagaattggtttggcaaggaaagagtctgaaagaacagtccaaatgctaatataattctctaaacgagatgtattaaggacccaaattagggctgacagcattggaaacaaaaggtacccaatttcccacacatatcaagggtaaactttgtatctgtaaacttcatcagagaaagtactgtcatacctcctcctcatatattctttttgaataaaaaggttttgttttgttactaatactctctaaaatacatatattgtgcatgagtctcttagagaacacaatcaagatagtaaaataagcaattaagg

SEQ ID NO: 106301 - DNA, 514 bp, Homo sapiens
ctggtaatgcatctgaatatttctactgttgtaatgatagggtcttccaaagtatctatggctcctgtgcccaaacctgattccttgctggaagttatcaggggcaagaatgccatcctgtcctggctttggccaaatcacacttctttttcctcaccttctgcagttgacatgtacctcggtcagcaggccaaatggaaattaggtgttcccagctgctttggagctgcactgctttctgtatggcatgtatattcagttggttgcagtttacaatgcattctatgtgtattgtggaagagaaaacactcaggaaagaaggtggtcaagcttcatttacagcatgctttattttgattggtaccctagtgctctgagccttttcttgagcaaagaatagtaacttgggagtgttttactccagacatgacttaaacagaatctggatcttctctgcaatgtctggatttgtaataaaagttctgtctcagtcaagggagtaggaatgcttttc

SEQ ID NO: 106302 - DNA, 3852 bp, Homo sapiens
  misc_feature (579)..(579): n is a, c, g, or t
  misc_feature (1352)..(1352): n is a, c, g, or t
  misc_feature (1548)..(1548): n is a, c, g, or t
  misc_feature (1589)..(1589): n is a, c, g, or t
  misc_feature (2388)..(2388): n is a, c, g, or t
atcagaactcacacttcttcctggcaaagaagtgcccaggacgggagctggggagccagggctgatctaggaggctgggagccaggtgacaggatggccccaaagagagttgtgcagctgtccctgaagatgcctacccatgccgtgtgtgtggtgggagtcgaggcacatgtggacattcacagtgatgtgcccaagggtgccaacagcttcagggtctctggaagctccggggtggaggtcttcatggtctacaaccgcacacgtgtgaaagagcccataggcaaggcccgttggccgctagacactgatgcagacatggtcgtatctgtgggcacagccagtaaggaattaaaggacttcaaggtgagggtctcctactttggggagcaggaagaccaagctctgggccgcagcgtgctttacctcactggcgtcgatatttcccttgaggttgacacaggccgcacaggcaaggtgaagaggagccaaggggacaagaaaacctggcgctggggccctgagggctatggggctatcttgctggtgaactgtgaccgggacaatcacaggtccgcngagcctgacctcacccacagctggctgatgtcgctggctgacctgcaggacatgtccccaatgctgctgagctgcaatggccccgacaagctcttcgacagccacaagcttgtcttgaacgtgcccttttctgattccaaaagagtgagggtcttctgtgccaggggtgggaattctctctcggactacaaacaggtgctggggccccagtgtctgtcctatgaagttgagcgacagccaggggagcaggagatcaagttctatgtggaggggctgaccttccccgatgccgatttcctagggctggtttccctcagtgtcagcctggtggacccggggaccctgcccgaggtgaccctcttcacagacactgtgggcttccgcatggccccctggatcatgacgcccaacactcagcctcctgaggagctgtatgtgtgcagagtgatggacactcatggctccaatgagaaattcctggaggacatgtcttatctgacattgaaagccaactgcaagctgaccatctgccctcaagttgaaaatcgaaatgaccgctggatccaggacgagatggagtttggctacatcgaggcccctcacaaatccttccccgtggtctttgactcccccaggaacaggggcctgaaagatttcccctataagaggatcctgggtcctgactttggatatgttacccgggagatcccgctccctggtccctccagccttgactccttcggcaacctggacgtcagcccgcccgtcacggngggcggcacggaataccccctgggccggatcctcatcgggagcagcttccccaagtccggtgggcggcagatggccagggcagtgcggaacttcctgaaggcacagcaggtgcaggcacccgtggagctctactcggactggctctctgtgggccatgtggacgagtttctgacctttgtgcctacctctgaccanaagggcttccggctgctcctggctagccccagcgcttgccncaaactcttccaagagaagaaagaagagggttatggggaggcagcccagtttgatgggttaaaacaccaggcaaaaagaagcattaatgagatgctggcagacagacacctccagagagacaatcttcatgcacagaaatgcattgactggaaccgtaatgtgctgaagcgggagctgggcctggcagagagtgacatcgtggacattccccagctcttcttcctgaaaaacttctacgcggaagccttcttcccagacatggttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctgagcctgcccccacccgccatcctctctgccctcttgctagggaaccctgccagggtgaaggcaaggaacaaccacctggcctccattctcttgggggagtcttggcactttgcaaacatcctggccaccatgggcaccaggacacagggatggataccacctaccctcgcctctggaatggcctacccaacccgagaagaatgcacctcattcttccctggcctctttcccacccacagcccccagaggctctagatcaacaatgttagcatgttccagaatggctgtgggaggcctagggagntgggccccacttagaattgctcccccttcattctgatgcctccctggggaacaaggataatgactttgcatctgcacctggaacggggcctgggggacctggggtctggtgtgccaggcaccaggctgcctctgctcttggaaaactaggaaaggggatcagaaacatcctctccccgctctaggtttcttctcccaaaggggacccaaggctgtgacacttacctccacccccatccagcacccttcagctgtgtgtggacaaacaaggacagaaaaacccagtgtccaagggccaatttaaatagaaaaaaagacaacaaaattttaatagctgactccgacctcagaagagtgattgctacctttctggaaagactttaattaccagagctggcttctcccagctcagaaatgctgagaagccaacgtgaggcctgaggacacacaaaggatgacggggcaggaggggatgaggtcagggtagcagagtgtgtgacgacggatttgggggcctagaggtgtccgtggttcctgggctgggattttggactctggatttgaagggagctggagcttccagatgtagcaggggtagggggccagatgttagaagagggtgtgtgtgttgggaggaaattaggttatctctgaaggtggagtttaatttcctttaatagtctttaattattccccttcattctgcaggcagtgggaggggaaggcttgcccggtctctctcagcaacccagggaccctgcacatagcttaggtttcatccctgaataaaccgctgtgcaggcccatgtcccctcccacagtagggaagacagctgccacgggaggttaatagcccggagtgaggtcactgagacatgcacaggcaggctggttcagctgggctgcagggcacgggcaggaggaagccagcctaccctcttcccccactgccagtgaggccattgtagggcagttggccctagggcttcggtccatctaggttttcagtggcccctgctgagacctcacactgagccaactactgtcactgttttaaccaacaaaagctagcctggaactgctatggttaaagtgggtgagcgggaacctgaaaatccccttctggaaggttctacagaactctatttgcaagctcctgctttaacctgagcgtcctctgctcaggatcataccccagcctgcactgagtcaagaaggagaaggaggctctgaaggggccgggggtgtgagctggggttgggactcccctgagaaagagctgtgggtaggaagggagtgagcattgcagagatagggctgggggtcggggccacactgagtgtgggaagctctggagttgctgctgggccatcgaggggccctggtgttggctctgagaatgttctgggtgaccagtcacctactttctgatcaataaaaatgtcgacatgcatttcttacaaag

SEQ ID NO: 106303 - DNA, 492 bp, Homo sapiens
gctgctggggcctgcaggtgggatagagcctctgccttcaggaacccacagtctgatggaagagacagagccatgccctcagagagctcccagcctaatgagggagacccggccccacgctggggcaatgacctattttcacagaagcaaatctgagcctctcatctgagaagtctggtgaaatgcattgactggaaccgtaatgtgctgaagcgggagctgggcctggcagagagtgacatcgtggacattccccagctcttcttcctgaaaaacttctacgcggaagccttcttcccagacatggttaacatggtggtcttaggcaagtacctgggcatccccaagccctacgggccacactgagtgtgggaagctctggagttgctgctgggccatcgaggggccctggtgttggctctgagaatgttctgggtgaccagtcacctactttctgatcaataaaaatgtcgacatgcatttcttacaaag

SEQ ID NO: 106304 - DNA, 506 bp, Homo sapiens
atatcttctataacccttcccctatctccagttattttaaaatcttactctgagggttactgtagtgtataaggttgtttgtctctacagtaaatgattccagtccctttaaccatgtgaaaggagacaggaacactagcatctgatcctcgtcatgggaccccagcctgtcttactacaattgccagctggagacagaacagggcctaagggcaaaggcagaatggcatatgaggaagagaaccaaaggtcagtcacagaacagctgtgtcacaggtgagatctaaaggaaaactgcgggactaaaagcaggaagcaaacagaagttcaggagccagaggaatgcaagaacatatcaggaagggggatatgagacaggaatagaatcagggctttggccatgaatgaggccagggtacctcaagctcattcttgttgagagcttgccctgtggtgcttgggtaagcaggaaagagttaggcagtgcaggttgggacagtctttaa

SEQ ID NO: 106305 - DNA, 121 bp, Homo sapiens
tctgtaaagccatcattgcagtgctgtcaaccacaactcttcctgtcagtgtcctcctgggaattggcatgactctcacactctccacatgattctttttttctccacctgctcactcacc

SEQ ID NO: 106306 - DNA, 283 bp, Homo sapiens
aaaattttgggaaacaatcagctgctacaaatgtgctttgtatgaatacttttttaaaaaacaagttttgcttagaaaacacctaactccaaaattatccccaaagtctgcaactttcaagctaaaatgctaaataataaatatcagttatcgttataaaaaagaataaaattcagtaagaaatttaatgtctatcatttccccccaaggttcattaatacactttattaagcatattattatcattcatcttgattctctcacaatattgtttaggaatgat

SEQ ID NO: 106307 - DNA, 462 bp, Homo sapiens
attctcatctcctctatcagatccttctcctcttaactccaaattgggaactcttcatggcttcatgcaaggttcccctgtcctcctctataccaacactgtccaatagaactccctgtgacgatggacatgtcctctttctgcaccatccaatgaagtagccactagctatatatggcgactacgcacttgaaatgtagctcgtgtgactgagggatggaattttaaattttatttatttaatttttttattgagagttttgctctgccacgcaggctggagtgcagtgatgcaatcttggctcactgcaacctctgcctgctgggttcaagtgatcctcctgcctcggccttcggagtagctgggattataagaatgtgccatcatgcctggctaatttttgtattttttatagagactgggtcttgaactcctgacctcaagtggtctgcccaccttgg

SEQ ID NO: 106308 - DNA, 336 bp, Homo sapiens
cgcctgccaccacacctgggtaatttttgtatttttagtagagacagggtttcaccatgttggccgaactggtctcaaactcctgacctcaggtgatctgcctgcctcagcctgccaaagtgctgggatttacaggcatgagccactgtgcccagcctgcagaaacttttcttgttctctttcaagataaatcttacctagttctgtcaccttacatagaaaacccaagtgcacttacagaccaattactacaaataatagaatttaacagtctggctggataaaaggtaatataccgaaggcagttgcattttttatacttacacaaataactag

SEQ ID NO: 106309 - DNA, 142 bp, Homo sapiens
gagatcgcgccactgcactccagcctggacaacagcgtgagactccatctcaaaacaacaacaacaacaatttttagtctttggcgatgccctgaggctcatctcttccacagaggcttggaggatcggccacacgagtggg

SEQ ID NO: 106310 - DNA, 243 bp, Homo sapiens
tactgaatacctgaattttgacaaccaaaaacttggtgaaacaaaatgagataaaatagactttctttctcagggaatctcttctttccttgaggctatattaatctgctcttaatacacagaaaaattaagttcttaaaattatttagagtacctcaaaagtatagcataaaactttataaaagatggacaaatataaataatatagaatatatttcagtctctggtgttttatgttcatca

SEQ ID NO: 106311 - DNA, 1186 bp, Homo sapiens
gttgtctgcagagagtctctttgttttttgtttctttgttttctcctcagtaatttttcttttccttttaagtccgtcttaaccattcttcctccagtttaatctctgagattttatttcatccatcttcttcccctctcccctaaccaaagtgttgtatttcatgcaatgaatcaaatgaacatttttatactttttttctcgcaacagtgaaatgcagactgggcagctgtgttgattaattggcatttaatgttaatgctagaattttattctaggcaatttgttctcctaatggaatattgagtattacctttagtactcaataagaaaagcctgaattataattctatataaaattaatgcattaactaaatgattgtattacagtgatatgtgtgatagattattatttttgtcctctccctcctattttctattttatgaaagatcttgtaattattttatctttctttttttttttttttagacagagtctcactctgtcacccaggctggagtgcaatggcacaatctaggctcactgcaacctctgccacccaggttcaagcacttctctgccccagtctcccaagtagctcccaagtggcacctgccaccacgcctggctaattttttatttttagtagagatggggcttcaccatcttgcccaggctggtcttgaactcctgacctcgtgatccacctgccttggcctcccaaagtgctgtgatctttcttaatgacacagaaaatcccattcaaataaattgtcataaacctttatgaaacttcttttcttgaaacgttcgtttttataagttcaaattataaggtaagatggtattgtttacttgttaaatatattttttcttataataatacgttgatatggtttggctgtgtccccacccaaatctcatcttgaattcccacgtattgtgagagggacctggcgggaggtaatggaatcatggggacaggtctttcttgtacttgttctcatgatagttaataagtgtcatgagatctgatggttctataagggggagtttccctgcacaagctctcttcccttgtctgccgccatgtgagatgtgcctttcaccttccgccatgattgtgaggcctccccagccatatggaactgtaagtccattaaacctctgtcttttgtaaattcc

SEQ ID NO: 106312 - DNA, 185 bp, Homo sapiens
ctggtcctctcatcaatgttctgtcacatatagtgacatttccccccaaaattttactatgaaaattctcaagcaggcaaatggtgaaataattttacagcaaacacccatttacccgctgcttgaattctgagcttaacacttgactatatatatttgtttttttgtttgtttgtttgtttttg

SEQ ID NO: 106313 - DNA, 100 bp, Homo sapiens
ttcgagtcaccagaatggaagtcatcttggacttagtgctgagaactgcctgcagccggccagccagccggcaggagaagctgccgcctacagccaggcg

SEQ ID NO: 106314 - DNA, 416 bp, Homo sapiens
gctgggaacaaatcttccagtctgttgcagatgtcctcagaggaaatcatgtttgtatgaaaattgtgtaaggtaggcaactgatggagcgtcaaacgtgaaagacggttcaatgagtttgcattgcagttaaaaacagaatcgagccatgtgacacatttacagccttgttgtggcatttgcaacaaagatgtccaaaagacgattccagtgcagaacatttaagtttcttaaggcatcacaaaatgagtcacatacagaaataaatattttacacatccatctctgtgatatgaatacttaacactcatatagcacttctattctgcttattaaatacatcacctaatttaattcctacaacaaatgagggtattcgcattatcatcattattctcatttaacagatgagaaac

SEQ ID NO: 106315 - DNA, 385 bp, Homo sapiens
  misc_feature (14)..(14): n is a, c, g, or t
  misc_feature (17)..(17): n is a, c, g, or t
tgagacggagccgnctngtgtctcccaggttggagtgcggtggcgaatctcggctcactgcaagctccgcctcccgggttcacgccattctcctgcctcagcctcccaagtagtgccctctttatttcatactgagatggttctaagtgaaacctatttggacacaaattagtgactctaattagaatagtgtacatcccactcaactcaatttaatggaatatttattggcatgatgtgaagaaactgaaataaactgtatcagagttgtgcccatggggagtttatggtcttattgagaaagaaagacataaaacagcaaataggataacagacataatgagattcttatgttttacagagacttgcagaatgtacttctcta

SEQ ID NO: 106316 - DNA, 205 bp, Homo sapiens
tttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgt

SEQ ID NO: 106317 - DNA, 697 bp, Homo sapiens
ccacctccaacactaccaccatttttcttaaagccaccatcatctcttccctggactattacaataccttcctaattatctccctgcctctgctattgattctttagggtccgttttccacacagtagccaaagcaatttttaaaaaaattattttaaaatgtgattctcttctttgtggctttccatcacagcctagaaaaaattgaaagatctgtaaggccctaatgacctgtccttcactacgtgtctgaccctatagcctactgttctccccttgtgcggtgtactgcagccacgttggccttcttggtattctttgaatacaagggagcttctacttcaaggcatttacattggctgttgccttagcttagaacgctctttctccagatagccgcagagcccgctctctcacctgactcatgtctctgctcaaatgttaatgatcaagaggcagtccccggcctccctcttaaaattacaacctgtcactctccaatcctttcctcacgattttctcaaaagcacttaccgctaaccaacattatatctaaatttttttttgtctctttttattggaatgtaagtttcatgtaagcaggaactgtatatcactgctataccctcagcatttaaaacaatggctgtacatcatacatactcaataaatatttgttggataaactaaaaaaatt

SEQ ID NO: 106318 - DNA, 137 bp, Homo sapiens
atcgcatttaatacttacctaatgatcttcctaaagttgtcattgtttctggaccataggcctgtagatttttcctctatttcctatagttcctgtgataaaaatagaatgccttattaaagtaaaaaatatcttct

SEQ ID NO: 106319 - DNA, 588 bp, Homo sapiens
gcctggcccagtgctgggtttgccttgttgacgatgcgcttggattgttaaggacaccgatgttcagaacccgggaagagtcatcttaacccacattctcagctgaatatgcagaccccaagcttgcatgtttatatacaccctaatcatgattccaaaacaaaactgttgttcagagttggaggtagctgagtgtggatggaggtattggtagactgccaggagggcagggggtgtggacaaaacagtgttttcatataaagctctgggacttttcttcatttgacttggtctgtcagataaaagttttgtgagactttagatgaagactggaagaagtgaacactttctccggcattctcaattagagcctgccactgtaactgtaatagagtaaaattggaggggcaagaggcatgagaagggattacgcagtcattgtcatttggaggacacacggctcttaggtccagtccagttttcttagtctgattagggaagtagctttgttgaatgcatgaactgagactctttgaggtgccggatttggcaagaaggggagtagctggagggagttggagaagtatg

SEQ ID NO: 106320 - DNA, 346 bp, Homo sapiens
cctccaaccactaaccccatggaccctgcactctggcctcagcaggctgctttttccccagtaagcatatacctggacgctgctgtgtctctgctccagctggtccctcatcctggaatttgacccacagcgccacctgccagccacccacacatcctttcaggccacttcaggtgactccttctgtaacatcacagacagagccaggcctccctatgactacactcccacagcactctctccacgctgtaacagaatctgtggccacgctgacctgactcccaccttcctccttaggaaaaaagactctatgacctctgtgcccaccacagtgcttggcacatgt

SEQ ID NO: 106321 - DNA, 405 bp, Homo sapiens
gtcctttaataaagatttgttaaaccgaactgaatgtgagggggtttaataacccatagccttccagtatacaagaatcagagagaaatttaaaaacagaagaagctgtcaacagagtaaagtaaaaatcaatatgttttctggttttagtgtcctctgctgtgtcaggcaaatagagaaagcatctgttttcacaaacaaaggaggtttgtcagcaaacatacctcatactttaacaaacacaaaggttaaaggttaaaaaaaaaagagtggggcagactcattgaattttacttttgcagtataaatctttgctcagttttgttttctaagttaccacttctctggcttcacttcttttgatgttttatttttgtcatctcctgcacttatgaaagccaaagg

SEQ ID NO: 106322 - DNA, 158 bp, Homo sapiens
gaagacgtgtgcccactcaccccaggtccaggcaaagccctgggacagcagcaccatggaagtctcctggccgcagcattcaaagaggccacaaacacctcccatcgctgcccacccaatttaaccctgctgtggctggcatgtgtgtgcactgcagt

SEQ ID NO: 106323 - DNA, 517 bp, Homo sapiens
gcaagaccataccacagtcccttctcaaaaacacataaactcctttattcataatgaaacagaaagctgggtttcaaaatacaatcccactccctctttatcttctccattatttttaaagattagaaataaggcctgtttttaagaaacagaaaatgtataccaacttctctcaaaccaaaagagaaaatccaaatttgatatatattttctatgttcataatattgagagtaagaacggactgttcatcaacagtatgttatgtgggacaaaaactaaaaaacgtatatcaaaaatacatactgtttgccgacattctttccttaatcataatcaaggagtatgtgcctaaattttactagatgtgagataagctttgtctgatatttcaagattcattcattcaacaaatactttactgagcacgtactataagccaggcccttcaacgaaacatttagattttgtaaactgcacatcaccccccaaaattcccctaaaaaagcttatcattta

SEQ ID NO: 106324 - DNA, 565 bp, Homo sapiens
ctctcttccactccctcctttgctgtgtgatggtcatctagccggtttcctgccttcccagctccaaggttcccttttctctttatttcacctccacactaccacaaaattatcctcctaaatggcaagtcccatgatttttcttccttgacccaaacccctgattattgaaattcaaacaaccttgcccaaattggacctaaactcccattccagttttgttttctatcgtgatgtcaacttcacccacccttcatcccaagcctctgttgcaagtacactgacttacttatctttcttacacctcccttcatgcttccaagcagtctcttccctcttattagaaggctctccccatcatgtctgctggctgaaagcctacctagcttaaaccttctagaggcatgatgttgtagaaaaatgcagcattagccctaaacagatctgatttcaaattccagatatgttactttataactctgtgcctcaagcaacaagaggtcacaccttctctgagcctcagtttgtagttttataaaatgggaatatatatattttgcagagt

SEQ ID NO: 106325 - DNA, 357 bp, Homo sapiens
aagatagcacttgcggaaaaaagtgaattaccattatgtcgaaagtgatacttttttacatttggccttttactgtaaatcgtggaagtgaattttccaagcctgtgacttggaattatatttttcatgctttgtttgcttttccagaggaaatagagtattatatatttgatattttaacataatacaggtatgtactttagttcaaataattaatggttttgttgaaatcaattatttttctttactacacatcagcaaacaatttttctaaacactataaaaattaactttcaggaaccatttggaatggtcagccgtaagccatgcagccatcgtgcttaaattggtttttgt

SEQ ID NO: 106326 - DNA, 377 bp, Homo sapiens
tgtaaagaactactgcatggttttccaaagtggttgccatttgacaatcctaccagcaacgtatgagaattccagttcctccctatcaccaacaatatttggtaatgtcagtctttttaattgtaggttttcaaatccatatgaagtgatatgatatataaccagtgggggaaattgggtgaagagtattctctctatactctctttgcaacttcctgtgaagctacaattattttcaaaataaaaaggttttaacacatattggtttttcaaactggtatgaggtggtatctcattgtaattttcttttgcatttatttgatttctaatgacattgagtactttgtcatgtggttattggccgcttatatatatct

SEQ ID NO: 106327 - DNA, 450 bp, Homo sapiens
ttaaagtataatagtaaaaaaaagaaaaagaaataataagccaaaaaaaagaaagtgttcaaagaattgtgggtacataagaaaaagccaaaaagccatgttaaagggcttcccattagtcaaatcttggaaatttgagtatcaaaataataatgacagtaactgattataactcattgaataaaataagaatccgtaagttcataatgagctacctacacacacatacatacatacatgcctataaaagaagagaaagctccttcttacagtacaaagcaaattaataaatatgaaaagaatgatgaacttgtaaagtcatcatttagcaacgatggttgtaataattgattcagacaagaatcattcatggatgctaaactagaatgtgtaaatttgatgagcaacaggatatctacatagtctcaaagtttctctctcaaatatgta

SEQ ID NO: 106328 - DNA, 727 bp, Homo sapiens
cttgggtggctagggtacaagcacctggaaccacaaggactaagaattggagaggatgattctccaagggaaatatggaatgagtaagtagggtgctgaaccaccccaaaaaagtcctgtctaactacctttgtacaaagtagtgctttctttctctttttttttattttttattttttaaaatttatttatttattatttttttgagacggagtctcgccctgtcgcccaggctggaatgcagtggtgcgacctcggctcactgcaacctccacctcccaggttcaagcgattctcctgccccagcctcccaagtagctgggattacaggtgcgcgccaccacgcccagcttaatttttgtatttttagtggagacagggtttcactatgttggtcaggctggtctcgaagtcttgacctcgtgatccgcccgcctcggcctcccaaagcgctgggattacaggcgtgagccaccacacctggccgattttgttgtctttttctagaagttttttctttgcagaccacctccaaaagtatcctttcgtgatggcccctccatctgagtgatggctttaggtggtgttggatggttagatttctttttttagatcttaggactcccagaactttactaactgttccatatagagaacaaccatggattctgtacaagaataagaggtttttttccctaaactttttattgaggcataaaatgcatac

SEQ ID NO: 106329 - DNA, 260 bp, Homo sapiens
tgaggttattttcttggtattgaatggagttccttatatattttggttattaaccccttatcagatatatagtttacgagtatagtgaaccattctgtatgttctctctctcttttttttttttttggtggagtttcgctcttgttgcccaggctggagtgcaatggcacgatctcagctcactgcaagctctgcctcctgggttcaagggattctcctgcttcagcctcctaagtagctgggattacaggcatgtgcca

SEQ ID NO: 106330 - DNA, 442 bp, Homo sapiens
accccttccttcccctggtacccccatcactgtcatttctgctgcatcacagacatagggttgcaaacaggtgtggttgtgactgagtctgtttctgacactccatcccttctcactctgcaggggaatcttgctggaaggtggctggaatcaggaatgaagccaaagggcagggctgacagggatcatttaaatgcttcaactccaagagattcacacagaatactggacacaattcagaagagtcacccagagggagacaacaatatcactgttacccatgagttgaaaaggcacagccttcaataatctcaggtcaccctaaaaaaggaaagagagattttatgagatgaaaatatgaacatttccattgtgaatgatttactgagaatggtaggggtgtggaagagagacactggggtaatggtatctgagatgcttg

SEQ ID NO: 106331 - DNA, 483 bp, Homo sapiens
gggggccaggccagggggtctccctggggggagcagaggagtgtcggacctcagaagaggctctgggggtctgagccgccaccgggcgctgccttccaggttcagcagggacagagctcagggggaaggcacctcccgtcctggttcaatacatggacccctgaccctgggaaagggactgagccaggggaggcctcaggtcactgcaccatgaagttgtggggagctgcgggggcctctgggctccgagctgggcaggcacagcgtggggaccacgtgctgaggggaagaagcgtgccagggtggacgtctcagtgcacacgcaggaacatgcaacggctgagccagcccagagaggcagcggagcgtgtgcggggcggccggcggagggagggagcatgtgccgtgtgttcgctggagggaggtagcatgtgccgtgtgttcactggaaggaggagagcatgcgctgtgtgttctctgacg

SEQ ID NO: 106332 - DNA, 2335 bp, Homo sapiens
  misc_feature (881)..(881): n is a, c, g, or t
gggggccaggccagggggtctccctggggggagcagaggagtgtcggacctcagaagaggctctgggggtctgagccgccaccgggcgctgccttccaggttcagcagggacagagctcagggggaaggcacctcccgtcctggttcaatacatggacccctgaccctgggaaagggactgagccaggggaggcctcaggtcactgcaccatgaagttgtggggagctgcgggggcctctgggctccgagctgggcaggcacagcgtggggaccacgtgctgaggggaagaagcgtgccagggtggacgtctcagtgcacacgcaggaacatgcaacggctgagccagcccagagaggcagcggagcgtgtgcggggcggccggcggaggagcagcaggatcccaggcgggagcgcacggccttttcggaggcaggttccaggacaatactaagcgtttacatcattgcactatttgatccaggaggtcccactgtggcgtttcatcgataaacgcacatgcgaggtggagggtggctggtgtggaatgtgcccggcagccttcatagcaaaggagaattctagaaccaaccgaagtgcccctctgaagggagctggtcccgtccgttccagccgccgtggagtaacacagccagcagtttccctcctgccacgaaagctcgagactgaaactcaggatgaactgttttcagcccgggtcaccccagccctggggtggaggcccattgaggatggccgagcaggggcgggcatccaggcaggtccagcagtcctggcgggctgaggagaaggaggtcagtgctcagggagacatccgcagagggacctggcaggcagagctccagaagggagggaactgcncagacagaaagctccagaaggctgcctgagggcctctgaggcctccggagtcaggcgccatgcatgtggaaggtggactcttcagcatgggtgggaccctagggggctgtggacccccggcccctgggacccacaggtgggagacaggagttccaaccgccagggggagagtcctggaggatcctgggctgttggcagccacccagcagggcccgtcctgggagtggggctggactcttcctgcaggaaaggctgggctggacctgctctgagaggcttcagaaccagccacacgaagaccaaagtgaagagcaaggagctgaactccacgcagaacacagcgcagcgtcctttaaaggaaggccaaaaacaacccaacaaaaatgccaggtgatcaaagcggtcacagcacaatgtccacatccaacgagaaattgctgctacgtccagacgcagggaaaggtggccgtgggaacgtgagtcagcagcaacaggcccagaagggcagccacggtggacttgtcagacgtggaccctgaaatgacaatcacagcatgatttcaggcaggagcctgaaatggtacagctttggacatcggtttggcaaattcttttagagagaaacacacaccttccctaggacccagcaactccactcctaataaccaagtgaaatggaaggagttgtcctcagcaaaacgtgtgtgcggaagttcacagtcactttctcggtgataaccaagagctggaaaccactgcaacacccaccagcaggtgaacggattaacacactgggctagggccacacaatgagatgctccgtggcaacacaaaatgaaccgtggacacacactgcacggcggatgaatatgcagacatcaggccacgtgaagggagccaggccccgaggcgccacgctttgtgattcagggtggtccctctgcgcccaagacccggctgcctcctcctcttcctggctgcagggagtgcttgtgtctgaagaacgccaggctggtgtccccagagggcggctggaggggctcagaaaccattttcaccttctgtctcctccatgtctgcactgtttgggaaagaaagcacgcagccaaagagcgcaaagaggctcagaggaggcccgggtgccctggagagacgctgcgtcctgacgacacagcatccctgtcccgcagcggagatttcccagatgaaggattccccggcgggagacagggccctgcacacaggtcctctgccacgctgctcaccatgcctgtgtgttatctccccatgaaaagtcacctaggccgagcatggtggctcacgcctgtaatcccagcactttgggaggtggaggcgtgcggatcatctgagatcaggagtttgagaccatcctgagtaacatggtgaaaccccgtctctaggaagaatacaaaaattaactgggaaaaaaatca

SEQ ID NO: 106333 - DNA, 2176 bp, Homo sapiens
  misc_feature (881)..(881): n is a, c, g, or t
gggggccaggccagggggtctccctggggggagcagaggagtgtcggacctcagaagaggctctgggggtctgagccgccaccgggcgctgccttccaggttcagcagggacagagctcagggggaaggcacctcccgtcctggttcaatacatggacccctgaccctgggaaagggactgagccaggggaggcctcaggtcactgcaccatgaagttgtggggagctgcgggggcctctgggctccgagctgggcaggcacagcgtggggaccacgtgctgaggggaagaagcgtgccagggtggacgtctcagtgcacacgcaggaacatgcaacggctgagccagcccagagaggcagcggagcgtgtgcggggcggccggcggaggagcagcaggatcccaggcgggagcgcacggccttttcggaggcaggttccaggacaatactaagcgtttacatcattgcactatttgatccaggaggtcccactgtggcgtttcatcgataaacgcacatgcgaggtggagggtggctggtgtggaatgtgcccggcagccttcatagcaaaggagaattctagaaccaaccgaagtgcccctctgaagggagctggtcccgtccgttccagccgccgtggagtaacacagccagcagtttccctcctgccacgaaagctcgagactgaaactcaggatgaactgttttcagcccgggtcaccccagccctggggtggaggcccattgaggatggccgagcaggggcgggcatccaggcaggtccagcagtcctggcgggctgaggagaaggaggtcagtgctcagggagacatccgcagagggacctggcaggcagagctccagaagggagggaactgcncagacagaaagctccagaaggctgcctgagggcctctgaggcctccggagtcaggcgccatgcatgtggaaggtggactcttcagcatgggtgggaccctagggggctgtggacccccggcccctgggacccacaggtgggagacaggagttccaaccgccagggggagagtcctggaggatcctgggctgttggcagccacccagcagggcccgtcctgggagtggggctggactcttcctgcaggaaaggctgggctggacctgctctgagaggcttcagaaccagccacacgaagaccaaagtgaagagcaaggagctgaactccacgcagaacacagcgcagcgtcctttaaaggaaggccaaaaacaacccaacaaaaatgccaggtgatcaaagcggtcacagcacaatgtccacatccaacgagaaattgctgctacgtccagacgcagggaaaggtggccgtgggaacgtgagtcagcagcaacaggcccagaagggcagccacggtggacttgtcagacgtggaccctgaaatgacaatcacagcatgatttcaggcaggagcctgaaatggtacagctttggacatcggtttggcaaattcttttagagagaaacacacaccttccctaggacccagcaactccactcctaataaccaagtgaaatggaaggagttgtcctcagcaaaacgtgtgtgcggaagttcacagtcactttctcggtgataaccaagagctggaaaccactgcaacacccaccagcaggtgaacggattaacacactgggctagggccacacaatgagatgctccgtggcaacacaaaatgaaccgtggacacacactgcacggcggatgaatatgcagacatcaggccacgtgaagggagccaggccccgaggcgccacgctttgtgattcaggaaagaaagcacgcagccaaagagcgcaaagaggctcagaggaggcccgggtgccctggagagacgctgcgtcctgacgacacagcatccctgtcccgcagcggagatttcccagatgaaggattccccggcgggagacagggccctgcacacaggtcctctgccacgctgctcaccatgcctgtgtgttatctccccatgaaaagtcacctaggccgagcatggtggctcacgcctgtaatcccagcactttgggaggtggaggcgtgcggatcatctgagatcaggagtttgagaccatcctgagtaacatggtgaaaccccgtctctaggaagaatacaaaaattaactgggaaaaaaatca

SEQ ID NO: 106334 - DNA, 2633 bp, Homo sapiens
  misc_feature (881)..(881): n is a, c, g, or t
gggggccaggccagggggtctccctggggggagcagaggagtgtcggacctcagaagaggctctgggggtctgagccgccaccgggcgctgccttccaggttcagcagggacagagctcagggggaaggcacctcccgtcctggttcaatacatggacccctgaccctgggaaagggactgagccaggggaggcctcaggtcactgcaccatgaagttgtggggagctgcgggggcctctgggctccgagctgggcaggcacagcgtggggaccacgtgctgaggggaagaagcgtgccagggtggacgtctcagtgcacacgcaggaacatgcaacggctgagccagcccagagaggcagcggagcgtgtgcggggcggccggcggaggagcagcaggatcccaggcgggagcgcacggccttttcggaggcaggttccaggacaatactaagcgtttacatcattgcactatttgatccaggaggtcccactgtggcgtttcatcgataaacgcacatgcgaggtggagggtggctggtgtggaatgtgcccggcagccttcatagcaaaggagaattctagaaccaaccgaagtgcccctctgaagggagctggtcccgtccgttccagccgccgtggagtaacacagccagcagtttccctcctgccacgaaagctcgagactgaaactcaggatgaactgttttcagcccgggtcaccccagccctggggtggaggcccattgaggatggccgagcaggggcgggcatccaggcaggtccagcagtcctggcgggctgaggagaaggaggtcagtgctcagggagacatccgcagagggacctggcaggcagagctccagaagggagggaactgcncagacagaaagctccagaaggctgcctgagggcctctgaggcctccggagtcaggcgccatgcatgtggaaggtggactcttcagcatgggtgggaccctagggggctgtggacccccggcccctgggacccacaggtgggagacaggagttccaaccgccagggggagagtcctggaggatcctgggctgttggcagccacccagcagggcccgtcctgggagtggggctggactcttcctgcaggaaaggctgggctggacctgctctgagaggcttcagaaccagccacacgaagaccaaagtgaagagcaaggagctgaactccacgcagaacacagcgcagcgtcctttaaaggaaggccaaaaacaacccaacaaaaatgccaggtgatcaaagcggtcacagcacaatgtccacatccaacgagaaattgctgctacgtccagacgcagggaaaggtggccgtgggaacgtgagtcagcagcaacaggcccagaagggcagccacggtggacttgtcagacgtggaccctgaaatgacaatcacagcatgatttcaggcaggagcctgaaatggtacagctttggacatcggtttggcaaattcttttagagagaaacacacaccttccctaggacccagcaactccactcctaataaccaagtgaaatggaaggagttgtcctcagcaaaacgtgtgtgcggaagttcacagtcactttctcggtgataaccaagagctggaaaccactgcaacacccaccagcaggtgaacggattaacacactgggctagggccacacaatgagatgctccgtggcaacacaaaatgaaccgtggacacacactgcacggcggatgaatatgcagacatcaggccacgtgaagggagccaggccccgaggcgccacgctttgtgattcagggtggtccctctgcgcccaagacccggctgcctcctcctcttcctggctgcagggagtgcttgtgtctgaagaacgccaggctggtgtccccagagggcggctggaggggctcagaaaccattttcaccttctgtctcctccatgtctgcactgtttgggtttgtacccgcctgtgtcgcttttgcacgggaagtgagatggagagacacgtgaaccaccattgctggggttccagcatggggccccaggggacccatggctttcccagaaggaagctctgccattggacagccggtctcaggctgctgcacaggcccctccccgccctcagccctggcctgcgggaatcaggaaagggtggggtccagctgcattgcgaatggactaaagccactgatttgcacacttgccaatggctgaaatggtcaataaaacgtcatgtaccttttgccacaggaaagaaagcacgcagccaaagagcgcaaagaggctcagaggaggcccgggtgccctggagagacgctgcgtcctgacgacacagcatccctgtcccgcagcggagatttcccagatgaaggattccccggcgggagacagggccctgcacacaggtcctctgccacgctgctcaccatgcctgtgtgttatctccccatgaaaagtcacctaggccgagcatggtggctcacgcctgtaatcccagcactttgggaggtggaggcgtgcggatcatctgagatcaggagtttgagaccatcctgagtaacatggtgaaaccccgtctctaggaagaatacaaaaattaactgggaaaaaaatca

SEQ ID NO: 106335 - DNA, 373 bp, Homo sapiens
gatactgatgctggaaaaaatggcctggggagtaatgggtagatacatggtaactgaaactatagggataactgtaacttagaacaatgtgaaggctgagaagagcaactggccaactcagaaacaccactgtttatgggacaggcagagaatacacaaaaggggatggcatagtggaagtaatgggacagagtttcttgagaaagtattattgtcactggttactttacaagagcaagtttagtgatatgaaaaagtagaaattaaactacagtgggataaagagtaaataagagaaaaaggattttagggccccacaagggcccttgtcattgatacagacaactctattttctcatctgcaaaactgaga

SEQ ID NO: 106336 - DNA, 623 bp, Homo sapiens
caatttggagaaggaagtactttaaaagaaaagttaaaaggcagacatagatagcatgaagcctaattgcaagatctttttcaaacatattagttttaggaaatagcacctgaatttaagtcccttaaaattgtctatgtcttcacgtccaagtctctatatttgcagggctgtgtacaatctagactgaacatgcttgacctaaaaacagaagtaatacctggggcaaagcacgatgtgcaccacagtcttctctctttagtgtgttaagataaagttgattcccagagtagcctgccatcactaactctgagggatggtgggctaattttgatagaaggagcagaggtggtagttaggaggaaggtgactcatcatcattgtatcagcaggcattgatgactggaaatatcagggggcacagcctgaaagagaatggcttaattggaattgatagtgggaacttggaaatcaatacatatgcactgaacagaaaatggtatgctataatctactatacactgtatgtgaaacccaagctccaaatttttcggcccatgcaatgtccagtaaaatttctcttagttacattataattgcaatgtacatgtatttgaggaaaa

SEQ ID NO: 106337 - DNA, 239 bp, Homo sapiens
  misc_feature (38)..(38): n is a, c, g, or t
tctagaggatcccagttctggtccccaactgtcatatntttgttataaattttattggaacacaaaaaaaaaaaaaagaaaacaaaaacaaaacaaaagaaagcaaaaggaggaagtttgattttgtcatcccatacttaacatgtaagtatatcctcaggctaacttatttttcaaaaatgtgatcatgctacacatattatgacttgatctttttatttatgtggtttttaaatatc

SEQ ID NO: 106338 - DNA, 651 bp, Homo sapiens
cagcaggtgactttaagaggaagctggttgggcatgggggcttacacctgtaatcccagcactttggggggctgaggcaggcagatcacttgaggtcaggagttcaagaccagcctggccaacatggtgaaacctcatctctactaaaaatacaaaaattagccagatgtggtggtgggtgcctataatccaagctacttgggaggctgaggcaggagaatcacttaaaactcaggaggcaggggtttcactgagccaagatggtgccactgcactccagcctgggtgatagagtgagactcttgtctcaaaaacaaaaacaaaaacaaacaaaaagccactgctcatttaccgtttctaaaatcctaggactcttaagaattatactaaatttaccatatctgtgttctgtaaataaaatagcaaagcctggatgctaacacccctgtttacagcatggtttactgattattttcagcttactgttgagacctactgctcagaaaccagattcctttcaaaatattactattcattgacaatgcactttgtcgtccagaagttctaatggagatatacattaggagagtaatgttgttttcatgtatggtaactgatatgttttggctctgtgtcccaaatctcatcttg

SEQ ID NO: 106339 - DNA, 341 bp, Homo sapiens
tgaaatggcaaatttttaattgaacctgctgccagcctcatacactgtcctgtttgtcatttatttcatgccaagcctgcccatttcctcccttagtactctctcctaacccctggaaatttgctctaccgacgatctctcaaaaggtcaccagtgcagcctgggcaacacggtaaaaccctgtctctacgaaaaatacaaaaaattagccaggcatggtggtgcacacctgtagtcccagctactcgggaggctgaggcaggaggattgcttgagcccaggaggtcaaggctgcagtgagccaagatcatgccactgcactccagcctggggggaaacag

SEQ ID NO: 106340 - DNA, 363 bp, Homo sapiens
accccccgccccaagcaatttgcatcccaaagcaagctagacttaatttagaaggacttttctataatgttttcatctttcagtagttgcatatatatatacgtttaacattttagaccatatcatagacgttcttctgtctttgcatctaccactacattttagaatgatgattcctttttctagcaattgatattttataggtacttaagagttaacgggtaagaattagcttcttttgaatctaagccttagaatcttaggatgttttaggtagatgtgtttagattagccagtattctaaaatagtaaagtcctaggagagaattgtcccttgttttgtttttcaaactcagttttccc

SEQ ID NO: 106341 - DNA, 583 bp, Homo sapiens
gaaagatttgcctaaagtgttgatattgaactacgcctgtttacctttaatcttcttttcttcccttgcagtatctcatcagggttgcccccagatgggaactaagaatgaattttggtaacttcctagggatggttgcatgaccttgtttttttctatgtgttctttaagcagtgagttctaggatgtatattcaggggtatcatagtatgtttccccttttgtggaaaaagtaaaccccttctaggcatagactcagacacaagaaaacagctagtacgactgtttacatgatgtctgccttctactgagcagttgtcacctttcccattgcagtgttgccttaacccatctggtgagtgccattggtgttaccaaattcttaaagaccttgtttggactttggcctttaaaagtggccagttctactcttcttagactgattatgcaatttttaaaattgcttttcactctgtactttttccctgtctctaacttgatgcttactcttggctttttaacaattaggggaactttcgctaaatgacaatgaagatacacacacccacacacaaaaaaaaaa

SEQ ID NO: 106342 - DNA, 371 bp, Homo sapiens
caggaatagagtgaatgaagtgcagtgaaaaggaagaatagcgagaaaggtgggcaggggccagagcacccaggccatggtaaacaatttggatttattcaaaacgcaatgtgaaacacaggtcattttggctttacctgtgttcacttggcaaatcaactctatttaattggcttcccaaaagccaaaacaaagttttctaaaatcagtaacctaaaggagatctttggctctgtggaaaaccacagggcgatgaacatttcagaagggaaccgtgatggttttggagtctgagctcctccctcccccagttccccagcacagctagcgctagctagctcccaagcaggccaattcagagacctgtaccc

SEQ ID NO: 106343 - DNA, 346 bp, Homo sapiens
tgagacagaatctcactctgttgcccagactggagtacagtggtgcaatcacagctcactgcagcctcacacttcccgggcccaggtgatcctcccatctatgcctcccacgtagctaggatgtagtcccaagctacaagtgcatgccaccatgctcggctaatctttgcaatttttttgtagagacagggtctccctgtgttgtccaggctggtcttgaactcctgggctcaagtgacctgcctgcctcagcctcccaaagtgctaggattacaggtgtgagccactgcgcccggccaataaagggttttttaacttcagcaattatattttcaatctctaggta

SEQ ID NO: 106344 - DNA, 355 bp, Homo sapiens
agaggatataggataaataccttttttcttgggagcaaagaatatgtagttgaaactcattaagggcaagcaaggtctgagtgtctttgaatttttgttcctggaatgatgccaggaatgtatagcagatctctgtacatgaataaatgaaaaaacctttctttgcatttgcatatactgttgctagcattatacttggttctgaaaagtaatagttaaatgagaaatggtctcagtggcacatgcctgtgatcctagcactttgggaggcggagagaggccaagacgggtggatctcttgagtccaggagtttgagaccagcctgggtaatatagtgagactcccctctctacc

SEQ ID NO: 106345 - DNA, 219 bp, Homo sapiens
gtttctaaagcatccagttggagaatggataaacaaagaatagatttgcctcctgtgcatggtgaaaatacagaggtccagtcttccagctggaagaaaaccttctgtttgtcctcttgcctgtccagtagctgctagtttcaggatcaaagaaggcaggttgtagtgctaaggagctgtgagcaggaaggtcatcattcactgaaaaaaaaaaaaaaa

SEQ ID NO: 106346 - DNA, 681 bp, Homo sapiens
aggcggggctaggcgtggccgacctcacactctccttgggcaggacctgctgcagctgctctcggggttggaggggaggttcctaggtcaatggagttgtgtacctaggaggattatggctgcctctgctgagtcatgcagattgtcaggaagtgtgagaaagccagcagtcaccggcctcacccagccaccctgccgccattaacagcactaggcaggcagtgcgcagagctgagaacttgccccaggttacccgcctcccagctgctaaacaaaagggaggcttttcagctggttcaaattgttacaaagttcagctagagatttgcttttacctgcggcgttttccccataccactggctgccctcccgaagaattcctgtgatgccaggcaggaatggcctggttggagaccagctagctcccagggcctttcccgctgcttcctctacccctgtatttcgctgggctctctaaatggattcagctccagaggaggaaaaccttgagaccctgagactttcagaaacttcttcacagttaccaaagctgaaaatgttcgtggcagggagtgggacatccggcttcagagcaggaactttcattgcaccagtgatgaaaaagagaatgaaatgtgggtgacgttgagaaaggcaagaagatttttgttcagaagtgtg

SEQ ID NO: 106347 - DNA, 1206 bp, Homo sapiens
aggcggggctaggcgtggccgacctcacactctccttgggcaggacctgctgcagctgctctcggggttggaggggaggttcctaggtcaatggagttgtgtacctaggaggattatggctgcctctgctgagtcatgcagattgtcaggaagtgtgagaaagccagcagtcaccggcctcacccagccaccctgccgccattaacagcactaggcaggcagtgcgcagagctgagaacttgccccaggttacccgcctcccagctgctaaacaaaagggaggcttttcagctggttcaaattgttacaaagttcagctagagatttgcttttacctgcggcgttttccccataccactggctgccctcccgaagaattcctgtgatgccaggcaggaatggcctggttggagaccagctagctcccagggcctttcccgctgcttcctctacccctgtatttcgctgggctctctaaatggattcagctccagaggaggaaaaccttgagaccctgagactttcagaaacttcttcacagttaccaaagctgagtcttgctctgttgccaagctggagtgtaatggcacgatctcggctcactgcaacttcctcctcctgagttcaagtgattcttctgcctcagcctcctgagtagctgggattacaagagtgtgccatcatgcccggctaattttttgtattttagtatagatggggtttcaccatgttggccaggatggtctcaatctcttgacctcgtgatctgcccgcctcggcctcccaaaatgccgggattacaggcgtgggacacagcgcccggctacatcttcttaattcttaatggtaccttttgatgaagtcacattcgtctttcatggatcgtgtttttgacctgccctgagaaatctcaaatatgtgatcacaatttttctcctgtgctttcttctagaaagtgtacaagcttcagcctttcatttctaggtttaatccagtgaggattacattattttccaatggcatatgggtccaggtccaaggtgtccttcatcattcatgattacttaatgttacatcaatgtatttggccgatccattcaatggtcctggactacttgccgacacagctatcagtttccacaacaattcttggctcttgggcaactccgttcccctattcggcccaccacattcatatagtgccct

SEQ ID NO: 106348 - DNA, 526 bp, Homo sapiens
gcgagcgttcgaaccgggaaaacatttgttcagctgtcaatcaaagtaacgtggggctgggagaatcggcggctgctgctgttgctgctgccctggctgcatcttcagaattaggtgttggtggtggtggtggtggtggcggcaaaataaagagggtggagggagcggtgagcctgggggctggtcaaaagatcttcttccgagtctcgtcctcccgcccacccgtctcccaacccagacaccttcggcccctcgctccgcagccgcgccaggaatgcggactaattagggtccaatgtctccttaaagagacaagctcggccttgtgtaacgcgccgaaacccctgttgagacaagagggggaggatcacgctgatcttacttcgttcggttcacatcaattttacgcgccgctggagccggcataattttccgtgtgaacgcgactcggtccccgttcttgtttagagccagaaatggagtcgcgagatgctggctggggccggggccgcggggtgggcgggga

SEQ ID NO: 106349 - DNA, 296 bp, Homo sapiens
atgaaagaaggaagagaataacatgttgaaagacaaagttgtcagaaatgggaagtcaagaacttttgagttctaagctctgagggaaaaatctacttcaagactgacatttctataataggttcccactcttaagattttacaataagaaaacatacacatgcaccaaaaacattttagggccgtagagatatcacaaataggatgaggattttccagcttgacagatcaggactcacactttcaatctgatttttactagccatgtgatcttgggctaccgacttaacctctct

SEQ ID NO: 106350 - DNA, 497 bp, Homo sapiens
ctgagcccctaacgctggggtccctgataaccgcggcagggtcagactgaactgaattacaggatgcctggctggtgtctgcagaggactggcgaattgttggtgtggaaaacccacacatttggtgcctgatgtgtagtgtgggtggaaatatccccggagcgacagggttggcacagctgcagactctaagtgccagctactgtcactctcaaagcctcatttaagctgtcactcattcaacaagccgctcatgacagccggctaccttgcaggtgccaagggcacagtgaggaagtcctgaccctgccctccaggagaggacagcccctctcccttcaccatgagcacaaatacctgcctgctcccagagctccccagtcttcagcaggtcgcacaggagggaccttacaaggtgctccccatcctgactacaaaagatgtgtacagaaggggccccagtggacggctgaaaactcaacacggggccagagcgg

SEQ ID NO: 106351 - DNA, 432 bp, Homo sapiens
aggtgcagcaaaccaccacggtacacatttacctatgtaacaaacctgcacgtcctgcacatgtatcccggaacttaaaattaaattaaattaaatttaaagaatagcttaaaaaaccaaaaacaaaccaaaaaatgccttttaaaaaatttaatttgtttgaaacaggatttaaaaagttctgtggacatggtggctcacacctgtaatcccagcactttgagaggccaaggcaggcggatcacgaggcgaggagttcgagaccagcctggccaacatggtgaaaccctgtctctactaaaaatacaaaaattagctgggcgtggtggcgggcacctgtaatcccagctgctcgggaagctgacgcaggagaatcatttgaatcctggaggtggaggaggttgcagtgagccgagatcgtgccattgcact

SEQ ID NO: 106352 - DNA, 390 bp, Homo sapiens
aaatcccacatatgatccaagagttttcaatagagtacacacattcacacaaaaatggcctttcaccctctgcagctttatctgtaattccttcatctgggtttaactctttcagaagctctgtggagcatctcatataggtagtggaaacatatgaagagcctagatggcttgtcactcctcagtgacacagacaggggagtaacacaaattggagcagggtaaacaatccatttggaaatttcatggccaatatgactttaaccataggtaagtccttcttaaataatcctcaaattacaaaatgaaatttataagaaactttaaaggtagaatttgaccagtaacagagagtgtagttttttcttttattctagcttttaatgaaag

SEQ ID NO: 106353 - DNA, 647 bp, Homo sapiens
aaacatttctgcagagacaaggatgaacttattttcctcttaagattggtctactagtctgatcatctgggattgaccatgcaagttttaatttgttttctattacttttatggatttaaaacatttttgtttgaaaatgttagtctttaaagataaagccaaaaatctgtttaaaaatacctgcttacagaatgaccaaaaagtagatgttttcatatttattaagttttcagacacgtcctcaacgaggtgctgctcacttcagggaaagatggccagttcaaactgctgatgaaaagtctgcaaccagcaagaccactgctgccagtgtgtcctgagggagcttgcatctgtttgactttacatatacatacttaggtttgtccatcagttgtatcctcttgaaggaggtatgtgagttcatggttttaagcatataaatttaaacgttaaaagaagaaatcagaagtagcccgtttgagtcttacatgagtgaaatgtgttgggtttcagcagcagaatatatagaaggaaatgaaacaatttttattaaagagcatagtttggaataaagaaagaatatgtgcacctagatgaacgaattagaactctgcctgccctttagggtttggtaatgttaccagat

SEQ ID NO: 106354 - DNA, 422 bp, Homo sapiens
gtgtttcatctggggtttttaaatattttaatgaatcaaatgtaggcacgtttagacgcttaatgggcagagccagtggagaggagaagctgatgttgcaagccaggaggtaatagaacaaggacctacaggagggaatccagagaccagctggccatatcttgtgtaacgcagcttgagcgctgtacaaccacaaggacactttccacattatagcttatgtgaacaaacagtgctaggcaggacaccttctgcatggtggagagagaaggtcataagcaatagaagaattagccttggccaatgaggaacagttggaaaagagtaaggggcacagatacaaaatactggtcctctttaaaatcagagtcaagtggctaggtgacaagagctagtgtcaatgttattttgccagattacct

SEQ ID NO: 106355 - DNA, 383 bp, Homo sapiens
cagttgcgtgctacttcaaaataaatgaatccagcataagggccattgtaaaaaaagaattcatgaagccattgctgaaggcacaccagcagatgcaaaaattgtgcacgttttgtgaaatagttttttatctcatgttgaaaatgtagcttttataggggtacaggattgctataaagaaaggcatccctataaactttaataagtttcaagaaaaagcaaagtcattatacaacttaaaacaaatggaaggcgaaggatctaaagctgaagaatataatgccagccacggatggcttgataattttagaaagagttttggctttaaaaacgtcacgataacaggagaagcagcttctgccaaccaagaggcagcagacgac

SEQ ID NO: 106356 - DNA, 220 bp, Homo sapiens
tgccttcccccaacagcccaaaagaagatatatctccgttgcacagataaggaaactacagctcaggcaaaatgccaaaagtcactgatagcaagtgatggagccaggatgaggttgcacatcctccttcacacgctctgctgccttccatcacgtggactttcttcagcaataatatcctctcacatcactaccaaagggatacagaatctggcctcag

SEQ ID NO: 106357 - DNA, 434 bp, Homo sapiens
gaaggaggaaggggagggaaaggtttactctctgtaataatattgttgacaactccaggcttttgtgactgggcagagagagcgaggctttaagagcagcagcgggggcttcctagttgcctcctgaccatgccgtcagaatgcttgtgacatggttctttttggttcccttaagtggttgtttcaagaagacgatgggcatgtgggataaaaggactcctacagagctggcaagggagccccgttagtgtcctgtgtcctggccgtgtcaggtggtgctggctgcagcagccactcccattctgtcacctgtttattcaacaatgtgcactgagggccttctaagtgctgggaacttagaagtgctcaaggtgcatcaatgagcaaaacaaagatccctgctagtggagaggaaactttaaggaggtgaaatg

SEQ ID NO: 106358 - DNA, 382 bp, Homo sapiens
tattcaactgcacacaaacgattctccagaatagatcatatattaaaccacaaaataagccctaacaaattgaagaagattgaaatcatatcaagtatctttcctgaccacaatggtctaaaattagaattcaataataggaaaaatatcagaaaaagtcacaaatatgtgaaaattgaacaatgtgttcctaaacaaccaattggtcaatgaataaatcaaaagagaattttttttaatcttgagcagaaaatggaaacacaacatttaaaacttatgggatgcataaaaataacagtcctaagagagaagattataataataaattcctacatcaaaaaagaagaaagatcccaaataagctaacattaaaccttagaga

SEQ ID NO: 106359 - DNA, 580 bp, Homo sapiens
tgatgatggtttggtccaggatgctagcaatatagatgttaagaaatcactggattctggatatattttaaagtcgtttgcaatagcatttcttgatagattctattgaaagccaaagagcaagaataatgctaaggtcgttggcttgagcaacttggagtttgaaattcccatcaactaacatagggagggctgtggatggagcaaattttgagagttaatcagaagttcagctttgaacatatttagtttggattgtctattaaactcccaagtgtagatgttgaatggaatttgtatatatgagtgtgtcgtttgtaagagaagactgaactaaaaatacaaatacgaaagttagtggtatacagatatttaaaaccaagagaatggaaatgagcatagacagaagtgggtcagtgttttctggattgccccaacaagaaaagttcatgccaaagagtaagaataagaaaaggaacctgagccatcactgcagtagtaggaaaaccaagattgcatgttaacttggaaaccaagttacgaaagtatttcaagaaggaggctatgattgacagtgaca

SEQ ID NO: 106360 - DNA, 252 bp, Homo sapiens
cctcccaaagtgctgggattacaggtgtgagccactgtacctggcctccaaaactttttttgacacaaggtcttgctctgtcacccagactggagtacagtgacatgatcatggctcactgcagcctcaacctccctggttcttgctcccacctcagcctcctgagcagctgggaccaaaggcacaggtcaccacactaggctaatgtttttattttttgtagactgggtctccctacattcccaatactgg

SEQ ID NO: 106361 - DNA, 157 bp, Homo sapiens
tgtaggttctgctgtgcatgtaggttcccctgtgtgtacgttcccctaagcatgtaggttcccccgtgtgtaggttctcccatgtgtgcgggttcccctgtgtgtgcagcttcccctgtgcttgcaggttcccctgtgtgtaggttcccctgggtgt

SEQ ID NO: 106362 - DNA, 624 bp, Homo sapiens
actctccatatttctacccacattctgatcatgaccacttagtaatcactataaagactgaagctgttgctacagtttttctcttattctgagccctccctagaattgcccttaatagtcaattctggatactgtagagtttctacagtattcacttcagaactgtttcagcctctacccattacccagtttgaaagctacttccacttttttaggtatttggcatagtaacaccccactcttggtaccaatttctgtcttggtctgtttgtgctgctgtaaaaaaatatctgagccttggtggtttagaaacactgaaattagttttgtcacagttctggaggctgtgaagtccaagaccaaggcattggcaggttcatttgtctggtgaggactgctctcttcatccaagatggcactttgatgctgcatcctccagaggggtggaatgctaggtcctcaaatagcagaaggcagaagttcaagctagctgaccactgtgtgaaacctcttttataagggccttaatcctatttgtgatggaggagacctggtggcctaatcatctcttaaaggctccacttaatactatcattaacaacacctgaattttttttttttttt

SEQ ID NO: 106363 - DNA, 334 bp, Homo sapiens
gtttaagctttgtgatgcaggctgccgtcgcttgaccttgagtagcatgggcacagcttatacttaagcaggcatcgctgtggcgagaattaggctataaaagaaaggacgctgtggtggttcctcaaaaaacttgaacagaattaccaattccatttctaggcatacactcaaaagtgacagcagggactcagatacttatacacccatcttcatggcaagactactcataaatgccacaaggtggataaacaaaacatgatatatatgtgcaacagaaaattattcagccttaaaaaggaataaaattctgatacatgctatataacatggg

SEQ ID NO: 106364 - DNA, 1586 bp, Homo sapiens
  misc_feature (723)..(723): n is a, c, g, or t
agcctaattcattcaacttttgaagcattggttgtgcgacatgcagttgggtgttgttgtggagaagaattgggccctttctgttgatgaatgtcagctgcaggccttgcagttttcagtgcatcacattgatttgctgggcatactactcagatgtaatggtttcacagggattcagaaagctgtagtggatcagaccgtcagcagactaccaaacagtgaccatgatcttcttttcgtgcaagtttggccttggggagtgctttgaagcttcttctcaatgcaaccactgagctggtagtcaccagttttcatataaaatccacttttcatcacatgtcacaatctgatagagaaatggtttgttgttgttgcatagaataagacaagatgccatttcaaaatgatattttttaaaatttttcactcagctcatgaggcacccacttatcaagctttttcacctttccaatttgcttcaaatgccaaaggaccatagagtggtcaacgttgagttccttggcaacttcttgtatagttgtaaggggacaacttagatgattgctctcatttagtcattgtcaacttctgatggccagccactatgttcatcaccttcaaggctcttgtctcctttgcaaagcttcttgaaccaccactgcactgtatgttcattagcagtttctcagccaaatgcattgttgatgatgcaagttgtctctnctgatttataacccattttgaacttgaataagaaaattgcttgaatttgctttttgtctaacataatttctgtagtctaaaataaacataaaataaacagaaagtaataagtcattagcaaaataacataaagtgagaaatgtccattaaaatgatgtataacaaaccacatttatttaagaatgtattccaatatcaaacagcaaattccaccaatacaaaaaaaatgcaatgagtttgcaccaactaataagactaacaactgacttcacgtcagaaaccaaggaagctggaaagcgtgagatgacatagttaaagttgtggcagaaaagggtgtcaactgagaactccatctacctcaactcatattcaacaacaaaaagaaaattaaacattccagaaaacaaaaactgagagactaatacaattaatattaaagtgaatctttcaaactgaaatgcaaggacagtatatggtttctcaaatacaaactaagaaataaagaacacccgggaaatgttacctacattgtcccttaggtcaatatctttctgtttgttactcatttcttgttctatctcttttaaatacaattgtataagcaataattataaaattatttgatagcttaacaaaaaatatagaaagagaaaaagggaattttaaaactatgttagaaaataatctatttaacaatcacaaaagacaggaatggatgaataaagaaatttttaaaaataaggcacatagaaaacaaatagcaaataacagatgcaaatcctacttcatctgtaaataaactaaattgaataattaaacatcccaaattgaaggtggatattgaaagaatggataaaaaaaaa

SEQ ID NO: 106365 - DNA, 604 bp, Homo sapiens
tgacaactgtcttatccggaagccttccaaactggtgtttgatactgaagagtggtccacagaaatgatttatataaaagaaacagatatgccaaaggaaacctctccttgagcaccccaaagaaggaccatctgcagaaacacaaccctgagggtaggtcagatgtgctggtcagtggagcaggtgtgttcctggggaggtacatgccccgtggtgggccatccactcccttcccctggatcagggctggtgacaatgccctcccttcaagctggcatgacatcaaggattcctccagatttaaaggaagtcaactccacaattcctgtgagaaataaacaggtctcaacctgggccaattccagggcccccaaggtctcctcttgacctcagaatcagcttttcttccctaaggtgtcattatatccaggacatcctttcagaataaactgcaggctaggggcaggcgtgcaggacacctgcactatctgtccagggcatgctggcattcccctgctgtgggctgggctcattcaagcccatcactgagtgtggcaaggacgaggcatccccctacagcagggtcagatgccgaaagagcct

SEQ ID NO: 106366 - DNA, 414 bp, Homo sapiens
attttactgagacacaccagaaacactctttgatcatcttgcttgatgagtgacttggcactttggatggctttttccattctcacttagctgtatcacattagtgtagttatcagcacagggtgtactttagaacactttggtgagctaatatcttctcctatgtgtttaggtagtaaccaatgaacctgtaatgtgaggattattaaggcacaggttggagatcaggatttcttactgtgtatgaggttttttttccctgtattcaaaaaatccaattaaaattaactttttattattgagggaacatatttaatttgctgtctttggcaaagtatttatactgttgtcataactaagtagatgactatataatttttcattcaaactggtacatttttgagaatgaaaggg

SEQ ID NO: 106367 - DNA, 1705 bp, Homo sapiens
tttgaagttacttatcttttaatacatgtatttaacaccatacttcatattattaaataggttttacttaaaaatataattattgtatttgtacctgtcagatataaatacttattcaggagttcacaggtacgaaaagatacacataaattttaggaacttttgagttatttctgtcatttttgcttttttctctttcttttcctaaattttatgtataagattacccctaaaaaaaaaaaaacagccagtattcagtgaattcaccagtaatttgaaatgcaccatattgtaaatgatccactgacagggaagccagcgtgttggagccatgccagccacctcagacaccgtggctctaagatgcggaagagtcactgcatcttcttgaatgttacagatttggtttgcctgaatgtgacttgacttctgttttgaaaaaacatacgaatagagttctattttccttatgtgatgctttcttctaacacactttaacacagaagcctaacctagctacaaagagcctatccacagacataggcaacagctccaaagggtatttcattgtgtcacctgcttctagatcatctgttagttaactgactttgtgcaaggtctcaccatgtatagcactgccttgcttgagcacggaagtttctgtcaacagcaagctttatgtgctctatcatttttattaaagtatttcagtcaatagtgacccattgtagaatggatgcaggattcacatgtgcaagtgctttgtgacctggcaccatttggttttggccaagcagcagagcagacctcaggacctaacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaatttttattggtagtagttatcaagaacaaagtcctcggacttctgatgggaaatctgaactgctgtttctcttttagcgtacaagaagaaatagatccctctcattagcactttaatatcagtgtcacgtgtctggaaggaaattgtattcatttaggtaagcaacacactacataaatatcatagctgttagacccaggggactctcaggtgccagaattggggactcctttaattggaagggagctaaagggtctacctcctacctagaagtcctttctatgtggatatgaattaaattctcttgtctgttttgctctgatggggtctgtgtgggctagctggctctggtgtgtgcctgacgacagactgaactccttaaccatttcagacagcttgaagatgtatgatcattatttgaaaagggagagagggaggactctttgttttctccaccagtttggctcctgaggtttcttcagcgttaggtttctgtagggcccagctttctccagtgtttggctactgcaactctgtgttctgccagtctcttaactcagacagaaacaatgcaaaccagcagacagagcatcaccttgaaagtactaaaacagctgtcaatctagaaatctctgccccgcaaaaactgtcataaatactgcaagacccatgttcagatttcccatcagaagtccgaggactttgttcttgataactactaccaataaaaattgagtatttga

SEQ ID NO: 106368 - DNA, 4237 bp, Homo sapiens
tttgaagttacttatcttttaatacatgtatttaacaccatacttcatattattaaataggttttacttaaaaatataattattgtatttgtacctgtcagatataaatacttattcaggagttcacaggtacgaaaagatacacataaattttaggaacttttgagttatttctgtcatttttgcttttttctctttcttttcctaaattttatgtataagattacccctaaaaaaaaaaaaacagccagtattcagtgaattcaccagtaatttgaaatgcaccatattgtaaatgatccactgacagggaagccagcgtgttggagccatgccagccacctcagacaccgtggctctaagatgcggaagagtcactgcatcttcttgaatgttacagatttggtttgcctgaatgtgacttgacttctgttttgaaaaaacatacgaatagagttctattttccttatgtgatgctttcttctaacacactttaacacagaagcctaacctagctacaaagagcctatccacagacataggcaacagctccaaagggtatttcattgtgtcacctgcttctagatcatctgttagttaactgactttgtgcaaggtctcaccatgtatagcactgccttgcttgagcacggaagtttctgtcaacagcaagctttatgtgctctatcatttttattaaagtatttcagtcaatagtgacccattgtagaatggatgcaggattcacatgtgcaagtgctttgtgacctggcaccatttggttttggccaagcagcagagcagacctcaggacctaacgaggatggttgtgattaggtcaaatagaaaactagcaggccattgctgacaatttttactatataattagaggacttcctaaaatgctttaaaaaaaaatgtgtatggatggaaaatacaaaggaatttttcaaatactcaatttttattggtagtagttatcaagaacaaagtcctcggacttctgatgggaaatctgaactgctgtttctcttttagcgtacaagaagaaatagatccctctcattagcactttaatatcagtgtcacgtgtctggaaggaaattgtattcatttaggtaagcaacacactacataaatatcatagctgttagacccaggggactctcaggtgccagaattggggactcctttaattggaagggagctaaagggtctacctcctacctagaagtcctttctatgtggatatgaattaaattctcttgtctgttttgctctgatggggtctgtgtgggctagctggctctggtgtgtgcctgacgacagactgaactccttaaccatttcagacagcttgaagatgtatgatcattatttgaaaagggagagagggaggactctttgttttctccaccagtttggctcctgaggtttcttcagcgttaggtttctgtagggcccagctttctccagtgtttggctactgcaactctgtgttctgccagtctcttaactcagacagaaacaatgcaaaccagcagacagagcatcaccttgaaagtactaaaacagctgtcaatctagaaatctctgccccgcaaaaactgtcataaatactgcaagacccatgttcagatttccccccttttacaaataatgttttgttttatttcccagctactacaagtgatccaaatgttctttatagcagactttttcctgcagtctaggatccagtcagagatcttgcattaaattatatctctgtaatctttaatttcacgctatctgcaatgttttgtgtttttcatgacattgatgtttttgatgaggtcaggccatttattctgcagaatatctgtcaatttggattttttctaattgttctttcatgattagaatcaggcaaacattttttgacaagaatacatcagagacgactccgtggtgcatcagactgggggcatgtgatgtctgtgtgtcccattattggcgatgttcaattctgtcacttctgttgaggctgcatttgccagatttcagattaaggtacctttttccctttgtaaattaggatatcacctttgtggggtgccgttttgagactgcaaggatatcatcttcccgagtaggccttcatccatggcctcagcatccatgatggttcctgtccggatgctcacttttgaagaaacatttcaaataatagtgattcctttccaattcaaaagtaatcattgctttatagtcttcataaatattttctgtggttatttagttgatgaaagctgttgatgtccatttggatttttttccctccaacacaaacagctgcaggaattggtgccacatagaggctcagcttgcctgtctccatggaagctgtggccacagcagtggctttggaagcctagtaaggaatgacatcactgccaggtgcagtggctcacacctgtaatcccagcactttgggaggctgaggtgggtggatcacttgaggtcaggagttaaagaccagcctgatcaacatggtgaaaccccatctctactaaaaatacaaaaattagctgggtgtggtggtgcgtgcctgtagacccaactacttgggaggccgaggcaggagaatcactggaacccatgaggtagagcctacagtgagctgagatcatgccactgcactccagcctgggtgacagattctgtctcaaaaataaataaagaatgacatcactgaatacactgaatgtgctattgataaccagtgtgccagactccagacaacatgtgccaggcatcacccatgtctttgattttgtaataaataaaaaatggggccaggtgtggtggctcatgcctgtaatcccagtactttgggaggcccaggctgatggatcacctgaggtcaggagttcgagaccagcctggccaacatgatgaaaccccgtctctactaaaactacaaaaattagccgggcatggtggcgggtgcctgtattcccagctactggggaggctgaggcaggagaatcacatgaacccgggaggcggaggttgcagggagctgagatcgtgccactgcactccagcctgggcgacaagagcgagactccatctcaaaaacaaacaaaaaaggcaaaatccttggagaactcttactgtctctgtttccagaatcctagaattaaaactttcatttatcttcacaattttcccatagctttttcatgtctgtaaggatgataccctgaaatcttcttcttgagaagataaagaagggtcccctctgttacccctaccaaacggatgctcctcacgggcttgaggtggcagctcatctcagagcatgggatgatttttaaccaggtgagtggaaaggggcagtaataaacatttttaaaggttggggacacatgaagtcctcagggtgtaaagctggaaccagcctcctgtactgctcagctttcaggcctttggcccctagtcccttgggggtggcccctcccttctctgtgccataacagagtacccgtcaccccctgcctggaccactcctgcagcagaagaggagctcacgacctcctccggcagcacctctccttcctccctgcagagcccggctctcgtgctgagcaagcagcgttcccagctcccagacaggccccccagaagtcggcctttctgttcaaaagcttccagctgagcatctgcccattctcctgatccgtccaccaggatcacatttcaacagtgcacgtgggagcatttgtcttgatggcctctgagatcatcctggccccggagtccccaatgtggtttccctggagattgatatgctggagcctgtggtttccagacagtgctgtggcaatgcatatcgccccgtccatccccagagaattctcttgaagattgagtctccggagacttgagtttaccttcagagcatttgccagggctttggctccagccaccccaatggcatttcctcttaagtcgagaatctccaaggttctgttcacagccaaggcttcccctagcacctgggcgcctgaagcaccaattgaggccacctggagatagagagcagtgagggctgtgttgaccttcagtgcacgggccaccgcacacgctccgtcatccccgatggcgttctcctgtaaatctaagctggtgaggctcctgttgagctgtagtgcttgtcccagggcctgggcagcgccggcctggatgaag

SEQ ID NO: 106369 - DNA, 394 bp, Homo sapiens
gggcccagcagctggagatggggcagaagaggcgctagagagagctgatcataagccacagaactgactctggcaagcagaagggatcaaggaaagacccgaagaaccagaccctggaaaggccgggtcctgggggatctggggagcaggagctttgagtggatggaggtttcttcaggaagagatgagaaaacaccaatccactgtgcccaaggttcagaaatcctaggagaacacctcggattggccagaggagggtggagcatctgggttgacacatccaagcaaaatggcggtggggagtttccaaagcagagccaaagagctgccaccagaggaagaggagctcctgaggggccacgcggaggtgctcggacctgccctgtagacagtg

SEQ ID NO: 106370 - DNA, 255 bp, Homo sapiens
gaaccactgtgctccagcttgggcaatacagcgagacctcatctcttaaaaggattaaaaaaaaggataaagactgtagcattttctcatagagtattctaagctttataaagttatttccccaacgctttggacataatgattaggtcatttgaagttctgagaaacagaatgattatggaagttacttaaaactacttcttaaagtataagaatattgctaggcgtggtgtaatccccactatttgggaggct

SEQ ID NO: 106371 - DNA, 721 bp, Homo sapiens
gagggggcttttaaacctcctgagtcaactgtccatatttgagtgagattttctgcctgtcagttgtatcgcacctgacttagcaatggcatagaaagacctgctttagcagatgtgtttgatattaagacttttctgttctgtttgatccatgttctggtgaaaatattaatctctttgatgacctcatattccttaggatcagcttcattttgcttcctgaagtttggtggtttctttaacctttcatcgtttctttgaccttgcatcagcaataatgggaaataaactgggaccctgtttatttacaaatgattgctctcgcaaggcatacattttaagggttgcaacattttttttcagaggccttaagcaaatagtgacgcttagagccttctcagatgcagtagtttcttttgctgtggaagcctgcctgcatttcagtgcaggggagaaatcagtctcagtctctccacgccctgccctgtgcatgcggaaagcctgcctcgtaccccgaccgcggaggcaggttacttatgtttcctgtgtgtcactcttggggtggttgcaaaatctgtgctttgtagatctgaaactaaggtatgtaatacttttttaaaataataataaacacatacgttgaacacaaaagcttttttctctctccttcgcttcacctttcctctgtttttgctcatttcactcttactcagcttctgtt

SEQ ID NO: 106372 - DNA, 691 bp, Homo sapiens
tgccacgaaaacacagagctgggatttgaacccacttccctcctaaggcttttgcctttaacgtgtttgtgtagggagaagaaaagcttttccataaatgacaggttttgagcccatcagttcattgaagaggaagtgtgtagccatctcggcttaattggaagacatgtgaaggtgatgggtaaatacgtagctgacatgtgtcacatgagtaatataggtgttgccctgtagactcactgtgttgccaacagtgagcaagtttttcccccaaggctctttaccagctaaataggcagaaatctagggggacactcaccttcctggatggaaagagggaaagaggaagaccttgcaggtgagttgcctgggtctgaaaaagacagcaattgcagcctattcttttttatttatttattttttgagacggagttttgctcttgttgcccagcctggagtgcaatggcacgatcttggctcactgcaacctccacctcccaggttcaagcgattctcctgccccagcctcctgagtagctgggattagaggcatgtgccatgacgcccagctaattttgtatttttagtagaaatggggtttcaccatgttggccaggctggtttcgaactcctgacctcaggtgatccacctgccttggcctcccagacttctgggattgcaggcatgagc

SEQ ID NO: 106373 - DNA, 691 bp, Homo sapiens
atattccaggtaccatgactgtgatccttggacagccaagaaagtgtctgcaccagaccagctcatgccttatttggtactggacattctgcaagattatccaggacttcctggactttttgtggcctgtgcttacagtgggacattaagcacagtgtcctccagtattaatgccttagcagcagtaactgtggaagatctaatcaaaccttacttcagatcgctctcagaaaggtctctgtcttggatttcccaaggaatgagtgtggtgtatggagccctgtgtattggaatggctgcgctggcgtcacttatgggagctttgttgcaggcagcactcagcgtatttggtatggttggtggaccacttatgggcctgttcgctttgggcattttggttccctttgccaactcaattggagcacttgttggtctgatggctggatttgccatttctctatgggttggaattggagctcaaatatatcctccacttcctgagagaacattgccattgcaccttgatatccaaggctgtaacagcacctacaatgagacaaatttgattacaaccacagaaatgccatttactactagtgtttttcaaatatacaatgttcaaaggactccactgatggataactggtattctttatcatatctgtacttcagcactgttggaactttggta

SEQ ID NO: 106374 - DNA, 805 bp, Homo sapiens
atgtcaggaaaatattctcaatggggaggaaaaaatatataaattttcaagagatgtggaaaggtagaaaactccagaattttggtctttttagagatttaaaagagatttagtctttttagagacttaaaaaaaacttttcactttgaaataattccagatgcataaaagtttgcaaaacaatgtacaaaaagtttccaaaacatgtgagtcttttacaattgtaaaaaaaaacatataatgcaaataactcttttaaattatctcttggcacctcttgtaatccttaatccaaatgacttctgttgatgggagaaagcaccattgccagtttcttgataaaagggaccaaataactagaaccatgtcttcttaggaaaagcaagaagtcttggcagatgtgcatctggcatatggctcctgagacactgacaggtcctgagctactcaattctccccagccgggtttgtattgcacctgaggttaccagcatctgctcagccttggcacagaagtcttgcctgttcctccttgggctctgcctcctaaacacctaccttgttataatcactcatgagttcaaccaagttagtccagcgctgccttgctactcacagtgaagtcctctgacctgcggcatcagcaccacgtgggagcttgttagaaatgtggaatgtctggccagacctcagacctactgcagcagactgcattgtaacaggatccccgggtgattcatatgcacattacagtttgggaggcactgctctaaagaaaaagcaaaaacaaatgaaaaagcaaaaa

SEQ ID NO: 106375 - DNA, 331 bp, Homo sapiens
ggcagtgaaatatcattcttggcatagggtacggagggtgaattgacaatgaggaggtcgtgtgtacaccaagtgatcagcagctggccaatgaaggctgattctaaagtgtctgcctggtgccagcctcagacactagattgtgggcaccaggtcactgattacaaaacaaaacaattacatttttttttcagatcctatattctcattgtagaaaatatggaaaatacagaaaagcacaatatagaaaatttcctataatccttccacgtgatgataatcacctaaactgccagtgattgtggcaattagcaggtctttttatgttgcc

SEQ ID NO: 106376 - DNA, 407 bp, Homo sapiens
gaatcaaccaaccctgaagcccaccctacagttggacaggtgctatgtgaaccaattcttaagtttccagcttaagctaatttgtgcaggattttttgcttgctactcaaggcaacctacttaatttaatgctatggttcctttctgtggaatatggatatttagttggtaaattcaatttcttaatttctagcttatcctgaactcaacctattctcacttgctgtagttaaagccctagaatggagaatgagagagaaatattcttgagccagctatcatttaaaccataattttgacttactacacaaaatccatgaaagcagtgcctctaaacagtaagagtgctaccaatgaatattaatagcaataattataagaaggataacaaatatcatggaggagtc

SEQ ID NO: 106377 - DNA, 302 bp, Homo sapiens
gataacaggtcaaactgccagcacctaaggatggactgaatctgacgaggtgagaggaggaggtgtcaagggtgactcctgggttctggttctgccatttaatgagcagggaacatgttaggagaaggtttagggaagatctttaatttggttttagacatctgactgcgcagaagtcatgtagccaggtgtaggtctggactttaggagagatcatggttaggacaataaactctgcaatcatttgtaaatggtccataactgatctaagggcattaataagactggggtggggatcgaca

SEQ ID NO: 106378 - DNA, 425 bp, Homo sapiens
atataaaattaatttttaatagttattttacccaaagtacccaaaatattattcttctaacatataatcaatatgaaaacattaatttaattttaatttttaattttggtgggtacataataggtatatatagatatgagatacgtgagatgctttgatacaggcatgcaatgtttaataattgtgtcatgaaaaatgagagatgagccactgcgcccagccctggtctctttttttcttttctgttctgaacatggtactatcttctgcatttccactcaattctgtgtccatagtgtgccttcacttttaaatttaaaaatctttcaatacttactttttaaaactagaaacaaaatttaattataattaaaataatagtagggccaggggtggtggcttacacctgtaatcccagcactttg

SEQ ID NO: 106379 - DNA, 2770 bp, Homo sapiens
gcatctcaataagaaccagctaagaaacaacattagacaacaagtcctcaaatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgttcctactcctgggcccagtgctaatgtagccaatgatgccatgtcgatattggaaaccataacttctcttaaccaagaagccagtgctgctagggcttcaacagaaacatcaaatgccaagaccagtgagagagcgtcaaaaaaacttccatctcagccaaccactgatactagtactgacaaagaaagaacttcagaggacatggctgataaagaaaaatctacagctgactctggaggtgaaggactggaaacagccccaaagtctgaagagttcagcgacctcccctgtccagtcgaagaaattaaaaattacacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatgatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagt

SEQ ID NO: 106380 - DNA, 2102 bp, Homo sapiens
gaagcagagctctcagaacctctcctggttccaacgcctgagtcatgaatcattctttgctccagaaaactctgttacatttaatttgtctgaaattttccttttaatagcataagtaactataatgtctaatttttctttgtcttatttatgtgtgagaagctgataagaaataaaaatatgaattatagcttttaaaagtcaatttctgaaatcttcacatcctgatatttccccttttggacctccaattcatcttgcctttactgcttgtacagcataatgttgattttatgctaattcacagacatactcctctttctattaactttcttacagatgaagagaagaacaaacagaataaaacaaaaactcaaactagtgattctagtgaaggaaaaacaaaaagtgtacggcatgcgtatgtccacaaaccatatctttactcaaaatactatagtgattctgatgatgagcttactgtagaacaacgacgacagtccattgccaaagaaaaagaagagaggcttttaagaaggcaaatcaatagagaaaaacttgaagaaaaacgaaaacagaaagcagaaaagacaaagtcttcaaaaaccaagggtcaaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagt

SEQ ID NO: 106381 - DNA, 1716 bp, Homo sapiens
gcactaatcctatgtaatatatgaaatcacacatacacacacttatgtgatcatttgaaataagagagataagacttcttcatccaaaatattatatctattccagcacaacttaagaatattaaagccattttggctttaacaatgattagaaaaatcttaatgaaaaattaatattacattgtttgtaaaacttttctgaaatacgttttattgattgcttcttttctaggcaggagtagtgtggacttagaagaatcatcaacaaagagtttggaacctaaagccgccagaattaaagaagtccttaaagaacggaaagttttagaaaaaaaagtagccttaagcaaaaagagaaaaaaagattcaaggaatgttgaagagaactccaaaaagaaacagcaatatgaagaagattccaaagaaacccttaaaacaagtgagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagt

SEQ ID NO: 106382 - DNA, 594 bp, Homo sapiens
cagtgtactgtgtctagttctaagggtgttttgttttgtctgtttcagtatttccactagtgacacagtggtagaaaagtttacagacttgtatagtatggtatatctaaatgctactgtagcatgaaacttagtttccattgtctatatccaagtaaatggattgggacaatttaaggttggatggatggatagatagatgacagattgtagagtgttattttaaagtaattaatgcaaataatatattattttttcacctttccataaattatcttgtgtttcagatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgctttgcttttactcttggtcagttccattgtttttcttcttgaactgaatatcaagttagggatacttggctctttaacacattttttaatttggctattccaatgaaattgt

SEQ ID NO: 106383 - DNA, 1372 bp, Homo sapiens
aaggggtgtgggggaggtagcccgcagtgcaggggcagcgcggcgcggggccaccgacgggacgcggctccgggaacatggctcgcttcgctctgactgttgtccggcatggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaaggaaatacggggttgtagaaggcaaagcgctaagtgagctgagggccatggccaaagcagccagggaagagtgccctgtgtttacaccgcccggaggagagacgctggaccaggtgaaaatgcgtggaatagacttttttgaatttctttgtcaactaatcctgaaagaagcggatcaaaaagaacagttttcccaaggatctccaagcaactgtctggaaacttctttggcagagatatttcctttaggaaaaaatcacagctctaaagttaattcagacagcggtattccaggattagcagccagtgtcttagttgtgagtcacggtgcttacatgagaagtctgtttgattattttctgactgaccttaagtgttccttaccagccactctgagcagatctgaacttatgtcagtcactcccaatacagggatgagtctctttatcataaactttgaggaaggaagagaagttaaaccaacggttcagtgtatttgtatgaacctacaggatcatctaaatggactgactgaaactcgctaaggttaaatctgcatcaaaatctaaccattttgagcctctgaagggagtgccattggctttatttacttctctcctctgctagttctgatttggaaacagttaaaagccaatttttagctccagtggaaccatagccacataaaactttaatggacaaccatatagaattaacttattttgtccaagtacagttggcattttccagaataattttaccaccctgctagatgtcatctctggattgcacatggatgatgaaggaactcagcattgaaagttgggggattagtaaccttgttacaacggtttctttttcattttagcctattttaatggctattggtaagatactgtatgtttttagtatctcatccagtgcttagaagaaagaatggtttataattcccagtacatgtttatattgactgtgttatatttttaaatcctttaaataaaaaatccttataagtttatgtaaagca

SEQ ID NO: 106384 - DNA, 1600 bp, Homo sapiens
aaggggtgtgggggaggtagcccgcagtgcaggggcagcgcggcgcggggccaccgacgggacgcggctccgggaacatggctcgcttcgctctgactgttgtccggcatggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaaggaaatacggggttgtagaaggcaaagcgctaagtgagctgagggccatggccaaagcagccagggaagagtgccctgtgtttacaccgcccggaggagagacgctggaccaggtgaaaatgcgtggaatagacttttttgaatttctttgtcaactaatcctgaaagaagcggatcaaaaagaacagttttcccaaggatctccaagcaactgtctggaaacttctttggcagagatatttcctttaggaaaaaatcacagctctaaagttaattcagacagcggtattccaggattagcagccagtgtcttagttgtgagtcacggtgcttacatgagaagtctgtttgattattttctgactgaccttaagtgttccttaccagccactctgagcagatctgaacttatgtcagtcactcccaatacagggatgagtctctttatcataaactttgaggaaggaagagaagttaaaccaacggttcagtgtatttgtatgaacctacaggatcatctaaatggactgactgaaactcgctaaggttaaatctgcatcaaaatctaaccattttgagcctctgaagggagtgccattggctttatttacttctctcctctgctagttctgatttggaaacagttaaaagccaatttttagctccagtggaaccatagccacataaaactttaatggacaaccatatagaattaacttattttgtccaagtacagttggcattttccagaataattttaccaccctgctagatgtcatctctggattgcacatggatgatgaaggaactcagcattgaaagttgggggattagtaaccttgttacaacggtttctttttcattttagcctattttaatggctattggtaagatactgtatgtttttagtatctcatccagtgcttagaagaaagaatggtttataattcccagtacatgtttatattgactgtgttatatttttaaatcctttaaataaaaaatccttataagtttatgtaaagcaaaataacactaacatgttttacgtataaatcaactattggaattttttattctagagggcttgaaatgtggatgaatacagattatgattgcagaatggtctgggggaagaagttaaaacatttgatttaaatacagtaaagaaagaatcttggagcagaagatagaagaacagccttttctaaataatgccttgccaaagtcaagtcaatggaaaccaggaaagcca

SEQ ID NO: 106385 - DNA, 1387 bp, Homo sapiens
agcagcgagttctgtttccgccgcaggcccgggttcacttgcggccgctggcacgcactgtacagctgcgtcagctgctcgcaggacacgtcccgtcccgcagctggtccaagtctgtgccgcgtggagaaacaagatttaacaaggagaaaataatccaaggacaaggagtagatgaacctctttcagaaactggatttaaacaagcagcagctgctggtatatttctgaataatgtgaagtttactcatgctttctccagtgatctcatgaggacaaagcagaccatgcatggaattttggagagaagcaaattttgcaaagatatgacggtaaagtatgactcaagacttcgggaaaggaaatacggggttgtagaaggcaaagcgctaagtgagctgagggccatggccaaagcagccagggaagagtgccctgtgtttacaccgcccggaggagagacgctggaccaggtgaaaatgcgtggaatagacttttttgaatttctttgtcaactaatcctgaaagaagcggatcaaaaagaacagttttcccaaggatctccaagcaactgtctggaaacttctttggcagagatatttcctttaggaaaaaatcacagctctaaagttaattcagacagcggtattccaggattagcagccagtgtcttagttgtgagtcacggtgcttacatgagaagtctgtttgattattttctgactgaccttaagtgttccttaccagccactctgagcagatctgaacttatgtcagtcactcccaatacagggatgagtctctttatcataaactttgaggaaggaagagaagttaaaccaacggttcagtgtatttgtatgaacctacaggatcatctaaatggactgactgaaactcgctaaggttaaatctgcatcaaaatctaaccattttgagcctctgaagggagtgccattggctttatttacttctctcctctgctagttctgatttggaaacagttaaaagccaatttttagctccagtggaaccatagccacataaaactttaatggacaaccatatagaattaacttattttgtccaagtacagttggcattttccagaataattttaccaccctgctagatgtcatctctggattgcacatggatgatgaaggaactcagcattgaaagttgggggattagtaaccttgttacaacggtttctttttcattttagcctattttaatggctattggtaagatactgtatgtttttagtatctcatccagtgcttagaagaaagaatggtttataattcccagtacatgtttatattgactgtgttatatttttaaatcctttaaataaaaaatccttataagtttatgtaaagca

SEQ ID NO: 106386 - DNA, 223 bp, Homo sapiens
gcaattcttggggcctttgtaacaagtccacatgtcccctcccttgtgccaaccctttcttcctttgacagccttccccactactctgaggaattcaggggccatgtcttttgtgcttggtacatgctagtgtgcaatgagatagacacatatctctcacaccaaaagccagcattttgctgccatttccaaaagtttaggaaggccatctgcttcaatcact

SEQ ID NO: 106387 - DNA, 978 bp, Homo sapiens
  misc_feature (964)..(964): n is a, c, g, or t
cgttttttttcttattactaagatgtaaaacgtagtaataagctacattgtgtccccagactcggccagacacatagtatcacacatagtatccagcatcaggccttgggccttccttgggcttattacatccagctaataagcctggatagagtaacttgcgtgcagtcacatagagatacgatggaaagtccagagttagagcccgtatccctgctcagaactccattcgatgggttttccattcccagacctagagtggggctcagggttcttagaaagtgagagttcagcatcccttcccattctcagagtgcaggtttgacttggtcctggtggctgtaccccaggagcaagaatcgggatgtggcacagggaggggaggtttttaccttgtcagcaatcatttgacctgtccaacacagtaactggtatttatgatttcctgtcccagatttccaggcctaactgccactgcagtgtcttccttggggggttggggaagctctagctcagttaacaattcagtccactgctctagggggagtatccttctcatagcccaaagactgagtgctggtggcatgcagaatctaccatgttctactcttcctaccctgatcagagtcgcagtgagatccaggagcatagttctagagctagaaggagctggaatcacttgttccaggttacgcagccattaagtgaccagatttttacctagtttttttttgttttgttttgtttgagacagtctcactctcttgcccaggctggagtgcagtggcaccatctcagctcactgcaacctccatctcccgggttcaaacagttctcctgcctcagcctgtaatcccagctatttgggaggctaaggcaggagaatcacttgaacctgggaggcagaggttacagtgagctcagattgtgccactgtactccaggcagggctctagagcgagantctgtctcttaaaa

SEQ ID NO: 106388 - DNA, 804 bp, Homo sapiens
  misc_feature (790)..(790): n is a, c, g, or t
cgttttttttcttattactaagatgtaaaacgtagtaataagctacattgtgtccccagactcggccagacacatagtatcacacatagtatccagcatcaggccttgggccttccttgggcttattacatccagctaataagcctggatagagtaacttgcgtgcagtcacatagagatacgatggaaagtccagagttagagcccgtatccctgctcagaactccattcgatgggttttccattcccagacctagagtggggctcagggttcttagaaagtgagagttcagcatcccttcccattctcagagtgcaggtttgacttggtcctggtggctgtaccccaggagcaagaatcgggatgtggcacagggaggggaggtttttaccttgtcagcaatcatttgacctgtccaacacagtaactggtatttatgatttcctgtcccagatttccaggcctaactgccactgcagtgtcttccttggggggttggggaagctctagctcagttaacaattcagtccactgctctagggggagtatccttctcatagcccaaagactgagtgctggtggcatgcagaatctaccatgttctactcttcctaccctgatcagagtcgcagtgagatccaggagcatagttctagagctagaaggagctggaatcacttgttccaggttacgcagccattaagtgaccagatttttacctagtttttttttgttttgttttgtttgagacagtctcactgtactccaggcagggctctagagcgagantctgtctcttaaaa

SEQ ID NO: 106389 - DNA, 1862 bp, Homo sapiens
gactagttctagatcgcgagctagaactagtccccacgcgtccgctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtt

SEQ ID NO: 106390 - DNA, 2307 bp, Homo sapiens
agttgttcagagtccagccaccggccctggggagggagagaagtcagggtattctgctcggggatggtcagggctccgcagctccatcgccagcatcctttggaaagccgcctctggcggagacagccggctgggggggcgctccaggtttggctgagacgttcccgccacagccggctccggcgccgcgcccagctgccgtaacatctcctcgcagctgcgatggtgtccaggagctgccgctgccgctgctccaccgcgtccagcagctgtctggcgcgctcctcccggcggctgttgggggtggcctcccgccgagccccagccccgccttcccgcggtccacgccggcagcctcccggtctccttcaatcctcctgggggtcgtggtccctttaagctgcccggcgcagaggcggggccgagtctcctggaccggaagctggctgggagcgtcacttcctcccggaagcgggcctgggcggatgtctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtt

SEQ ID NO: 106391 - DNA, 2274 bp, Homo sapiens
gactagttctagatcgcgagctagaactagtccccacgcgtccgctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtttgtttttcttcttttgaattatttccttaggagagtaggtcaaagtgtaggaagtatttatggctctcagtatggattagccttcaaaagaactgagtcaagttacactgctgttagcagtgtgtgagaatggctgcctctgccccctggccttcccatgtttagtatttttcagattgtgtgtgtgttaaatgaagccagtgttgctaccttctgtgaattactacaggtcaacatccaaccctttcagctgtccctgcctgccttggtttccccagctaagccccaaagccaggtggccaggcctgctcatctctctggtggggcttaatatcagttacctaactggggctgggtgtccttgaggtgaccactggggtctatttcctccttcctccccttccctcttgta

SEQ ID NO: 106392 - DNA, 2088 bp, Homo sapiens
  misc_feature (1863)..(1863): n is a, c, g, or t
gactagttctagatcgcgagctagaactagtccccacgcgtccgctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggttnaaaaaacaggccggacgcgggggcgagcggaacggcgggcgcggcggccgggggggccccggcagcacgccaggcagggcgggcgcgccgggccagagatagcagggacaccagcgcgggccccgacgcaagcgggaacagacgagacggtcctggacgggggcgggccaccccgcgcgggaggggagggagcgacgcggggcgcccgaccgcccaagacacgcg

SEQ ID NO: 106393 - DNA, 1220 bp, Homo sapiens
gactagttctagatcgcgagctagaactagtccccacgcgtccgctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtg

SEQ ID NO: 106394 - DNA, 1808 bp, Homo sapiens
gactagttctagatcgcgagctagaactagtccccacgcgtccgctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaatattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtt

SEQ ID NO: 106395 - DNA, 2277 bp, Homo sapiens
  misc_feature (1234)..(1234): n is a, c, g, or t
  misc_feature (1248)..(1248): n is a, c, g, or t
  misc_feature (1277)..(1277): n is a, c, g, or t
  misc_feature (1282)..(1282): n is a, c, g, or t
  misc_feature (1285)..(1286): n is a, c, g, or t
  misc_feature (1295)..(1295): n is a, c, g, or t
  misc_feature (1304)..(1304): n is a, c, g, or t
  misc_feature (1324)..(1324): n is a, c, g, or t
  misc_feature (1355)..(1355): n is a, c, g, or t
  misc_feature (1390)..(1390): n is a, c, g, or t
  misc_feature (1398)..(1398): n is a, c, g, or t
  misc_feature (1418)..(1418): n is a, c, g, or t
  misc_feature (1422)..(1423): n is a, c, g, or t
  misc_feature (1432)..(1432): n is a, c, g, or t
  misc_feature (1434)..(1434): n is a, c, g, or t
  misc_feature (1436)..(1436): n is a, c, g, or t
  misc_feature (1448)..(1448): n is a, c, g, or t
  misc_feature (1450)..(1451): n is a, c, g, or t
  misc_feature (1458)..(1458): n is a, c, g, or t
  misc_feature (1475)..(1475): n is a, c, g, or t
  misc_feature (1500)..(1500): n is a, c, g, or t
  misc_feature (1506)..(1506): n is a, c, g, or t
  misc_feature (1510)..(1510): n is a, c, g, or t
  misc_feature (1512)..(1512): n is a, c, g, or t
  misc_feature (1523)..(1524): n is a, c, g, or t
  misc_feature (1531)..(1532): n is a, c, g, or t
  misc_feature (1548)..(1548): n is a, c, g, or t
  misc_feature (1557)..(1558): n is a, c, g, or t
  misc_feature (1586)..(1586): n is a, c, g, or t
  misc_feature (1598)..(1598): n is a, c, g, or t
  misc_feature (1601)..(1603): n is a, c, g, or t
  misc_feature (1610)..(1610): n is a, c, g, or t
  misc_feature (1618)..(1618): n is a, c, g, or t
  misc_feature (1622)..(1623): n is a, c, g, or t
  misc_feature (1625)..(1625): n is a, c, g, or t
  misc_feature (1627)..(1627): n is a, c, g, or t
  misc_feature (1630)..(1631): n is a, c, g, or t
gactagttctagatcgcgagctagaactagtccccacgcgtccgctccggcgcgtcggtgcagggggatgagggccgcggtggctgccagcgtggggttgagcgaggggcctgctggctcccggagcggtcgcctcttccgcccgccgagtcccgctccggcggcccccggcgcccggctgttgcggctcccggggagcggggccgtgcaggccgcgagcccggagcgcgccggctggaccgaggcgctgcgggccgccgtggccgagctgcgcgccggcgccgtggtggccgtccccaccgatacgctgtacggcctggcctgcgcggcgagctgctcggcggctctgcgcgctgtgtaccgcctcaagggtcgcagcgaggccaagcctctggccgtatgcctcggccgcgtggccgacgtctacagatactgccgtgtgagagtacctgaggggctcctgaaagacctactgccaggaccagtgaccctggtgatggaacgctcggaggagctcaacaaggacctaaacccttttacgcctcttgtaggcattcggattcctgatcatgcttttatgcaagacttggctcagatgtttgagggtccgcttgctctcactagtgccaacctcagctcccaggccagttctctgaatgtcgaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgggggccgcgcgggngggggggggggggngttgggggtgcgggccggccgggggggcnggggnggnnggaggaggntcggggggnggcgggggggggggcgggcnggggggccgcggcgggggggggggcccgggngggggggcggctggagcccgggagttcggtttctntttgggtntttttgcaggtcgccgtggntggnngaggagganangnaagggcgcgggngnncaggggngccgggggggggggccngggggggtggaaggaggggggggcngcgggncggncngccgggggggnngtggggnngggggggggcgggganggggagggnnggcggggggggggggggggggggggggngggggggggggnggnnnggggggngggggggngggnngnanggnngaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtttgtttttcttcttttgaattatttccttaggagagtaggtcaaagtgtaggaagtatttatggctctcagtatggattagccttcaaaagaactgagtcaagttacactgctgttagcagtgtgtgagaatggctgcctctgccccctggccttcccatgtttagtatttttcagattgtgtgtgtgttaaatgaagccagtgttgctaccttctgtgaattactacaggtcaacatccaaccctttcagctgtccctgcctgccttggtttccccagctaagccccaaagccaggtggccaggcctgctcatctctctggtggggcttaatatcagttacctaactggggctgggtgtccttgaggtgaccactggggtctatttcctccttcctccccttccctcttgta

SEQ ID NO: 106396 - DNA, 2758 bp, Homo sapiens
cgttttttttcttattactaagatgtaaaacgtagtaataagctacattgtgtccccagactcggccagacacatagtatcacacatagtatccagcatcaggccttgggccttccttgggcttattacatccagctaataagcctggatagagtaacttgcgtgcagtcacatagagatacgatggaaagtccagagttagagcccgtatccctgctcagaactccattcgatgggttttccattcccagacctagagtggggctcagggttcttagaaagtgagagttcagcatcccttcccattctcagagtgcaggtttgacttggtcctggtggctgtaccccaggagcaagaatcgggatgtggcacagggaggggaggtttttaccttgtcagcaatcatttgacctgtccaacacagtaactggtatttatgatttcctgtcccagatttccaggcctaactgccactgcagtgtcttccttggggggttggggaagctctagctcagttaacaattcagtccactgctctagggggagtatccttctcatagcccaaagactgagtgctggtggcatgcagaatctaccatgttctactcttcctaccctgatcagagtcgcagtgagatccaggagcatagttctagagctagaaggagctggaatcacttgttccaggttacgcagccattaagtgaccagatttttacctagtttttttttgttttgttttgtttgagacagtctcactctcttgcccaggctggagtgcagtggcaccatctcagctcactgcaacctccatctcccgggttcaaacagttctcctgcctcagcctcccgagtgagtagctgggattacaggcgtgtgccaccatgcccggctaatttttgtatttttagtagagatggggtttcactatgttgaccaggctagtctcaaactcctggcctcaagagatccagcctcccaaagtgctgagattacaggcgtgagccaccatgcctggtctttttacctagtttttgactcttgaccctgttctcttatctttgcggcaagccaggtcaaagaaaagatcatcctagtcctgtcttggctacatagattagaacaaatgaaatgaggacataggatcatctagtccagcccacttgtcttgtaggcctggatagagtaacttgcatgcagtcacacggagatacgatggaaagtctagagttatagcccgtatctctgcccagaactccattcattgtacttatatttccctaactgaagcaatgtgtgaaatttccttttgacatagcaagattttctttaaaccctagataggtgttacttggagtgctaacccaggaggcctccaaacctcatagaatacagtgtctttggcacagttgaccttaactaaatgaagctcctttctctgcttagaggaaagtgccttctgttttaagactatatggcctttgatgactgcgtgcagtttgacattattggatacaccagggatagtgtccatgctcttccttctccctcttctcaggagttccaggatctctggcctcagttgtccttggttattgatgggggacaaattggggatggccagagccccgagtgtcgccttggctcaactgtggttgatttgtctgtgcccggaaagtttggcatcattcgtccaggctgtgccctggaaagtactacagccatcctccaacagaagtacggactgctcccctcacatgcgtcctacctgtgaaactctgggaagcaggaaggcccaagacctggtgctggatactatgtgtctgtccactgacgactgtcaaggcctcatttgcagaggccaccggagctagggcactagcctgacttttaaggcagtgtgtctttctgagcactgtagaccaagcccttggagctgctggtttagccttgcacctggggaaaggatgtatttatttgtattttcatatatcagccaaaagctgaatggaaaagttaagaacattcctaggtggccttattctaataagtttcttctgtctgttttgtttttcaattgaaaagtaattaaataacagatttagaatctagtgagagcctcctctctggtgggtggtggcatttaaggttcaaaccagccagaagtgctggtgctgtttaaaaagtctcaggtggctgcgtgtggtggctcatgcctgtaatcccaacattctgggaggcccaggcgggagaactgcttgagcccaggagttcagaatcagcctgggcaacatagcaatactccgtctcataaaaattaataaataaaaagtctcaggtgaccaaaggctcctgaagctagaaccaggtttggataaagattgaagagccacaggccactcttccctctgagccattgggcctagtggtgtcatgtattgtaattgctcgcagggagagcagtctttttggtgtaatagtgggatgtctgcttagttggcaggggttcagtccaaatggaagaatattgggaaataaacctccactatcctttatagccagggacttttttcttatttattcataaaataaattatagttaattatacccataacacctttatttaaatccagtgttctccgcagccttttgtctatttatatgtgtaccaagtgttaaacataattattattgggcatttgaactttgtttttctttaaagaaatgctgctattaaacatatttgtaaatggtt

SEQ ID NO: 106397 - DNA, 629 bp, Homo sapiens
gcagcaacacacgagaaaggcagggaccctgttcccttggcgtatttgtgctaattggggaggcccccgggaaaaaagcaaacaaacacagtagcttaatttaatagcgaatgccttgaagaaaataaaacgtggagcttgatcccactatcatgatatcacagcggtgcagctgttgtagtccctgagaccagaggcacatgggcgtcaagccaggggtgcgcctctggagccctgctttctgctcaagctcttagggaggtgaagcagggagacaggcggctcccattgtaaactcgaaggattccttttctacgtctgcctagagtctaggaaaggaccaccagtggcccttcaattttgaatggatttattcttctgtgtttcccagatactgccgtgtgagagtacctgaggggctcctgaaagacctactgccaggaccagtgaccctggtgatggaacgctcggaggagctcaacaaggacctaaacccttttacgcctgtgagtcaagttttctcttgtgtccccagactccaggccacttggctttcactaggatccagataagacttaccctcttatcccttccaacctttctcatgatccctttccccttgccttaca

SEQ ID NO: 106398 - DNA, 274 bp, Homo sapiens
taactttttgtatgtcatttactatacacacatagctttttattagtgtatatacacaaagggattttatcttatctctaatttatatcaacagtagcatttaggttttcagtgttcatgtctattcaactatgaccattaagactttccagactacatttgttaaaaaaatctatctctctctctatatatctatctctatatatctgcatatctatgggtattacaaaaattcattttatttaacaagtttttagaataaagtgttaataat

SEQ ID NO: 106399 - DNA, 414 bp, Homo sapiens
gtggctgggagaacccccagcgctgggcaggggcaccccagagagaatgctcgtggcccctccttcgcagctctgaaggcaaggtgtgtgccccaggctccatgggcagagttggctaaaggctggaatccccttcacttcagccctagcttggtggttctcaaactttgctgcactttggaaccacctggggacctttaacaaatactggtgcgtggctcccacccccagacattctgactgaattggtagagggtgtgacctgggcataggagtgtgaacatttccccaggtgattctaatgtgcagaaaagcttgggaaccaatggacgctgtcttttgaggtctagttctgatgtttatggagcaacaccatcctagaggttgagggtggagtagggtccctggaacaag

SEQ ID NO: 106400 - DNA, 300 bp, Homo sapiens
tagccccaggccccagccacctagatgcaccttacatgctcacctgagcagccacctgcaaggctggctcccacttcacaacgggagtccaaggccaggcccaggactcaagaactcctactggcgagcccggggctgagattcaaactcagcttcctgacaaggtgtggtccggatgttaaagacaaggaagacagaagagtgccacctggggctctaggaacccttaacatgacccagctgcctcctgcagtggagatggtgagactcaggcagaataaagataccagctgtgtctat

SEQ ID NO: 106401 - DNA, 2713 bp, Homo sapiens
  misc_feature (1189)..(1189): n is a, c, g, or t
aaacatatgtgctgctaataacagagccctagaatgcataaagcaaacctgacagaattgaagggagagagagatagttctacaataatagttgaggactttaatacccaactttcagtcatagatagaataactggacacagaatcagcaaggaaatggaagacttgaacaacactgtaaactaaatctaacagacatctctagaatactctacttaatagcagcaccatacaggttgagtatcctatctgaaatgcttgggaccagagtgtttttatattttgaagtatttgcattatacttaccagttgagcatcccaaatccaaaaatcacagattcaaaatgctgcaaaacgtttctagcaaactccagtgggcattttctttgagtcatcatgctgcactcagaaagttttagattttggagcattttggattttcaggtttggggtgctcaccctgtattcttaagtgcacatgaaatattctctggggtagaccataggatagtctataaaacaagcctcagctggatgcggtgactcacacctgtaatcccagcactttgggaggctgaggcaagcagattgtgaggtcaggaggttgagaccaacctggctaacatggtgaaaccctgtctctactaaaaatacaaaaaattagctgggtgtggtggcacacgcctgtagtcccagctactcgggaggctgaggcaggagaatcgcttgaacccaggagctgagacggtgccattgcactccagcctgggcgacagggcgagactccatctcaaaaaaaaaaagcctcaatacatttaaaactgttgaaattagacaaagtaagttttctgactataatggggtgaaattagaaaccaggagtagagaaaatgttttaaattcgtaagtatgtggaaattaaataccacagttataaataagcaatggaacaaagaggaaatcacaaaagatgccacaaaacactttgagatgaacgaaatgaaaatacagtgtgtcaaaacttatgagatgcaagaagagcagcccttagggggtaatttatagctataaatgcctatatttaaaaagaagaaagatctcaaatcagtaacctaactttgcaccttaagaactagaaaaacaacccaaagcaaggagaaggaagaaaatagtaaatattagagtaganatgaacaaaacagagaataggaaaaaaatagagaaaatgaacaaaacccaagttggttctttgaaaagataaacaaaattgataaacccttggctagactgaccaagaaaatagaggactcaaatccctaaaatcaggaatgaaatagggaacattacttccgactttacagatattgaaaggattataagggaataccatgaacaattatataccaacagattatgtaacctagatgaaatggacaaattcctagaaagatataaatactaaaactgactcaagaagaaatagagaattgaaataaacctgtaagtacagagattggattaataataaagaaaaacattaaaaaaatactcatcaaagaaaaccctaggccagatggcttcactggtgaattataaagaaggttgaatgccagttcttcacaaacttttccaaaaaataggatcaatgggaacacttcctaacccattctacaaggccagtattacaaaaccaaagataacacaagaaaactacagaccaataccggttataaatatagacaaaaatctttgacaaaatattagcaaactgaatctagcagcatattaaaatgactatatacgatgacaaagtgtaatttatctcaggaatgaaagcttggttcagtatatggaaattaatgtaatataatctactaataaaggacaaaaaacacgcatggattatctcaacttatgaagaaaaaccatttgacaaaattcaacatttgtttgtgataaaaacactcagcaaactaggaatagaagggatattcctcaacttggtaaacaagcatttatgaaaaaccgacagctaacaatcatacttaatgctgaaagattgggtaccttcctcctcccatcagtaataagacaaatatgtctgttcttgccatttctatttaacattatactggtggttctatataggtcattaggcaataaaaagaaaaaaaatccaaattaggcaaaagtaaagctacctatgtttacagttgatatggtcacacacatttaaaaaacctaaagaatctaccagtaattatcagagctaataaacaagttcagcaatgtccaggatatgagatcagtaaacaaaaatcagttgtatttctgtacactaccagtgaacaatctgaaaaggaaattaataaaacaattcaatttataattagcattaaaaagaataaaatacttaggaatcaatttaccaaaagacttacaacgcttatagataacaaactataaaattattttaaggaattaaagacctaaattggacatcccatgtatatgtattggaagtcttaatattgttctgatagcagtactccccagtaatctaggaattcactgtaatccctctcaaaattgcagctgctttttttgttttgttttgaaacagggtctcctgtcacccaggctgtaataaagtggtgcgattggctcactgcagccttgaactttcaggctgaagcgatcctcccatctcaac

SEQ ID NO: 106402 - DNA, 803 bp, Homo sapiens
aaacatatgtgctgctaataacagagccctagaatgcataaagcaaacctgacagaattgaagggagagagagatagttctacaataatagttgaggactttaatacccaactttcagtcatagatagaataactggacacagaatcagcaaggaaatggaagacttgaacaacactgtaaactaaatctaacagacatctctagaatactctacttaatagcagcaccatacaggttgagtatcctatctgaaatgcttgggaccagagtgtttttatattttgaagtatttgcattatacttaccagttgagcatcccaaatccaaaaatcacagattcaaaatgctgcaaaacgtttctagcaaactccagtgggcattttctttgagtcatcatgctgcactcagaaagttttagattttggagcattttggattttcaggtttggggtgctcaccctgtattcttaagtgcacatgaaatattctctggggtagaccataggatagtctataaaacaagcctcagtgggattacaggcacgagccaccgcacccggcctctttttttaaatagacatttttttcgaccagttttaggttcacaacaaaattgagcagaatgtatagtgatttccctcataccccctgctgcatgcatgcgtagcctcccctattatcgatatcccccaccagaacggtacatttgttacaactaatgaacctacattgacacatcattatggcccagagtccatagtttgcattagagttcactctctttttttgagacagagtctcg

SEQ ID NO: 106403 - DNA, 617 bp, Homo sapiens
ctgttcactctttgggtccgcactgcctttatgagctgtaacactcaaactgcgaaggtctgtggcttcactcctgaagtcagtgagaccatgaacccaccagcaggaagaaattggacacatctgaagaaacaaactccagacacaccatctttaagagctgtaacactcactgcaaaagtccgcgacttcattcttgaagtcagcgagaccaagaacccacaggaaggaataaattccagacacactactactgtccctgttcattaatctatttattcggcaagaaaatattgataacacgcactgtcctgtgtactagagatggacagaatcatgacttttggcttcagggcctcacagttcagttggagagagcaacatggcaccagttgattccagggcaacacaattagtgacataacagagacagatgaaagggattgcagaagcagagagagcatcctgactaattgaatctgcaaatggtgaagaagcccttccaggggtgatgctgtgagctgaattgtgtattagtaggaatttctcggttcaacacacagagaaataacaagttttctgttgtaaactattccttactaattaaaaacaaagtg

SEQ ID NO: 106404 - DNA, 166 bp, Homo sapiens
catgtagtctcttggaaagctggttaatttcaagtcaatcacagcagttctggcagaggagcagccccatcatttctccatttggtagacaccagttaggaagagcccttgaaacttgtcctcttctgccttttactgattcccctcccagaggaaagctttgtgt

SEQ ID NO: 106405 - DNA, 478 bp, Homo sapiens
aagatctgtgagacggctcattccattgctaggtgagtgagtgttctctcggtcgtgagctctgcctcctgggttcaagcaatccccctgcctcagcctcctgagtaactgttactacaggtactcaccaccacacccagctaatttttgtatttttagtagagacagggtttcatcatgttggtcaggctggtctcaaactccttaagtgatccacttgcctcagccttccaaagtgctgggattacaggtgtgagccactgtgcctggccaacagttacattttctaaagtgagtaatgtaagtatgtatataggtacaggcttgtttctaatcagtagaattggtggctccaagtagctgcctgtaaagctatcatttacttactgaaggttttctatatgccagggacagggctaattgtgttacatgtattatctcatttagacctcataacaattctgtgacgttggaatta

SEQ ID NO: 106406 - DNA, 559 bp, Homo sapiens
cagggcgggctgccccttatccagagtccatcacttctccagtccagatcctggctccaggcccactttgagtgctgctggcttgtcccggaggactgtgtatgaaaacaggagctcctggaagcacagtctttgttcggagagcagttagttaatcaaaggatgagggaaggataattggagagacagcacgactactgcaaaggtttggtgccccacatggccagggactctccagcaggggtggccgcctttgagggctcttttgggaagggatgggtgtgtacctggaagacacatacagtggttggttattaaacgttaacgaatccgtgcacattttatcaaatgtcttcttttctggtgaaaataatatatggttctcctgaactctcaggggagtggaaggaaaagggccagttggcacacaatggagcatacatgtcttttattctaaaaactattaagagacctgaaaatatgagcaatatagatagtaaggaggcaagaaaaaaaaggatgtctattagaccaggagtccccaacccctgggtcatgg

SEQ ID NO: 106407 - DNA, 426 bp, Homo sapiens
ccataaccttgatatccaaactagacaagaacaatacaagaaaagtaaattaccggccagccttacttgtgaacataagatataaaaatctttacaaaatattagcaaagcaaatccagtaatgtattttaaaacaaacggggagccgggcgcagtggctcacccctgtaatcccagcactttgggaggctgaggcgggcggatcatgaggtcaggagttcgagaccagcctgaccaacgtggtgaaaccccgtctctaccaaaaatacaaaaattagccaggggtggtggtgtgtgcctggaatcccagctactcaggaggctgaggcaggagaatcacttgaacctaggaggcagaggttgcagtgagccgagatagcaccactgcactccagcctgggcgacagagagagactccgtctcaaa

SEQ ID NO: 106408 - DNA, 735 bp, Homo sapiens
caaaccaatttttcctttgctgtttgttattagtcattcaaatatttgccttctcattgagttagcgttttagtcaaaatagctttcaatatgctaaaataagtaaactattaagttctggtggagtttttaaattaaaaataatttattatgcagtgatgtatattaaatggatagtttaatatatgtatatgtaaataatgtttttaaatagcattatatttaatataatatttaaataaatgttgcccacatttaaaaatttcttatttgtttttagtttagtagctctaaaaattctttaaaatataatacaaaataaaacacagtagattctgtcaattactgaagagtgtatgcatatataacatacctatatgttacacatatataacatgcacatgtataacaacatataatgcttttctttgttgtttttccaagggccattattataaaatcagagatatgttcttccagaaaatgtttgacttgaaacataatggaaaattttaaattaaataacatttaattttaagtaaaaacatcttctgacatgatataaattctcaacctattattgtaatgaattttaccctaatatattaactggtaaaaaatatgaaaaaatacctaaggttgaaatttcttcttaaaatatacgtgctaactttatttatttatttatttatttattttcagacggagtcttgctctgtcgcccaggctggagtg

SEQ ID NO: 106409 - DNA, 457 bp, Homo sapiens
accagagcactagcctcatgcggaggtttacaccaagctgaaactaagtggtttttctggttttccaagaaatcgagaactgaaagaaagaagaagaaagaaagaaagagagagagagaaagaaagaaagaaacaaagaaacaaagaaagaaaggaaaagaaaaaaaaaactaaggccaggcaaggtggcttatgactgtaatttcagcactttggaagattgaggcaggaggatcacttgaggccagaagttcgagacaagactgagcaacagggagacccctgcctctacaaaaaaatttacaaattagccagatgtggtgacacatacctgtagtcccaactactcaggaggctgaggtgggaggatggcttgagcccaggagctggaggctgcagtgagctatgattgtaccactgcacttcagcctgggcaacaaagggaagccctgtctga

SEQ ID NO: 106410 - DNA, 456 bp, Homo sapiens
tgggattcaccaccttaaaaagcagataaaacaattaaaatgtgttaggttttataccgaagttttatattgaatttttaaaaatgtgaagtttaacctgctgccttcccttcttatgcatgtattcatttacaaatgctttcagtatgactttggacagtcattcagtcaaaacttctctgcaaaagttaatagtgactatcttttaaaaatgttttgtctgtaatattcttctcacctgtacatattgattacccttaactatggtcacgttcttgatatgatagagacctttaacatctaatgtcctaactaatgattgctttatagaaaaatgatgggttgttaaagaatattcaagtgacataactttaaaaattaaatacactaacatagcaaatcatccaatgtgtgaatatttaaaggatctattgacctcactattgctttataatg

SEQ ID NO: 106411 - DNA, 420 bp, Homo sapiens
gtcatgttcagctatggtcatcaacataggagtgattctcattccttctacaggaaatatatgttgggccacatactgggccaaccattgctagacaagaaagctatgccctatttgcatggcacatgtattttatcttgagagcacatctcaacagactgagattctaatttctgattctgcaacggtacaaccttgagtaaattattaaatatctattcttcccttctgaaaagtacagatgctgcccactcacaaattatccagaaggatactatgatgctgacagtttataaaacagatgaattttaagaagaaaagcagtcatgttgctacttagtaacaaaagatttgagatttaatttaaaaacttaatgaaatcttgtaacttcatgttaataggaaatttttttagagtac

SEQ ID NO: 106412 - DNA, 415 bp, Homo sapiens
gtgtggggattcatgggggtgggaattttctggagacccttttcaggagtccatgaggccaaaattattttcttaatactactatgaggttgcctttttcattcacattctctcaagatgtagtagttttttaagagctacctgagaagtgctaacgttagcaacagaagcagctagagaatccagttctcacatgaaatcagacattagagacttttcttactagatttaaaaaaaattacttgtcataaaaatgttgtttgttagctggtaacgcattagtaattttaaatcaatattttaaaactttaattctaatatagtaagtattgatataactgacagaaacaaaagctccctgggctctttaacaatctttaagaccgtaaagggatcttgaggtcaaatttgagaa

SEQ ID NO: 106413 - DNA, 265 bp, Homo sapiens
taaactcgggaggtggagatttcagtgagctgagatcgtgccactgcactccagtctgggtgacgaagcaagactctgtgtcaaaacaaaaccaaaaacaaaaaaaagatacctaaatgcttaaaagatgaaaaaattcaagtgatacaagaatgtattaaatagagcgaaagccacttacaatctcacctctcctcctctagatgcagctggtgttaaggctcactttcatgactgctgacaccagcatatgttcagtgtcctc

SEQ ID NO: 106414 - DNA, 341 bp, Homo sapiens
ggactcccacatggctttcctctttcctttgagctggattcattttcactgagtcccgagtcctgcacatctgacaattgcttcagaccttggacatgcttgaattattttatgcaaatcatttgaaaaggcaaagtaccactgttctttcttgagtttcttcgtaaactggtttctaatttatctgctgctttttctcgatccaatttgtgcctatgtcttactatagattctttggaaataaagaaataaagaatatatctgtagctattttgttaaactaagaatgttttaaaatattttattgtaaaataaaattcctttgttctctcagaacttag

SEQ ID NO: 106415 - DNA, 318 bp, Homo sapiens
ttaaataaatgtctagctcagcttgtgtttcttcttttctaatatgtattaaagctatacattttcccctaagtagaggggctgtatttaacacatgttaatattcagtaatgattagtttgattcgttttaaatattttttagtttccattatggtttctcttttgacccaatatttagaaagtatgttttaaaagctctgatcatattaggtttgctttagatgttgaaatcaattgcattgtaatcagacaatacagcttccatgatacaggaaattttctatctacttagagtaaccatttaaaaaaaatacag

SEQ ID NO: 106416 - DNA, 776 bp, Homo sapiens
ctaaatttgatgttaggtacctataattaccttcccttcttcttatttttacaagacagaatgccagcagaaaaaaacaaattcctgttcacttggtaattttaaacacaaccaggtcaaaagtttcaaatctagtgttaagtccgtaactgaaggcaccattccaaaactacttgagtataggtgagaacttgacagataattatggttgcttgacctgggtcttggggcatctaccaaatcttaatggtagtctcactgtctgtggccatgtgagctataatctactgccctggtcaaacttaaccaaaattctgttttctttcagaagattccctaacattggaataaatggtaagaatatagattgtttgtgccgggcttatacaatgggtctctaaactatattgagtggtcaaaatgccacattcagaatacttagagagggagaaagataaagtgccttggaagccgtgaaacattctagggagcaagagcacaccactgtacatgctcctggtttgtgtgctgcagactgtgttaaatgcagaggaggcaaggtggagagaaggaaagacaagagaagtggaagatagagtccactcccctatccccgtcaatgagaagaagctccttaccaggtctgtgtgggtcacggggcaagatcaaagaatccaagcaaggttcataaaatgccaccacccctgattcatgacctgacctactgaaaggtttaacttccagaggcaggttgtggtttctgatccaatcaagtg

SEQ ID NO: 106417 - DNA, 291 bp, Homo sapiens
aagaagtaaaactttcccaatttagacagcatgattttccatatagaaaatcctcaagattctgcaaaaaagctacatgaactaataagtacattcagcaaggttgaaagttagaagattaatatccaaaaagcagttgcacatacatttattaacaacaagcaattgggaattaatttattataacaaatacagcaccatttacaatagaagcaaaaacatgaaaaatttaggagtaaatttgacaaaatatgtgtaaacctgtttactgaaaactatacagcattgtag

SEQ ID NO: 106418 - DNA, 366 bp, Homo sapiens
ctgtggcgcgctgtgcatgttcactggggtggggggtcccaggcgctcagaggagactgcagaataggcccgagaggagaggggagttcgtttcgccgccgtcttcatgggcgagcttcctaaccgccacctcgccccggagcaattggcacattgtattgaacgctgctgttcttcttactcttcctccttgtgatctctaatagaactgttagaagcaggacagagccaaattggcttggaccaagtccgtcttgggcaccccaggctggcctgttctctccaccctcctcacactccggggtaccttgaaacccccgtctcttacgaaaaatacaaaaattagccgggcgtggtggctcatgc

SEQ ID NO: 106419 - DNA, 379 bp, Homo sapiens
agatgatcagtaaatatcatgaagccttggagacctgagggcagagaggttggcatagctctacccagtgcccttgaagaagcatctggcaggctattcagggaaactgttcaaggacaggtttctgacgctggggtgggacatgttcacaagggccaagaacagagccaggtaccaaagaggcgacttaacagagtaatctatctggcagggactgtgcgattgctttctgcacagttcaggccttgcctcagttttgcctattgtcactccatttattccttatcctctcccaagtaaagtaattcctggaaggacattctctagcatccctgagccactcatttgcattccgtggcccttaatgctagaggcttct

SEQ ID NO: 106420 - DNA, 601 bp, Homo sapiens
ctagaggatcccctcgcgaaggtgtatccacaaataagcaatccagataggacttatgatttagctgtctcaatcctgactatcacagccaatattccgtagtgcctatagctatatttggatagctaggaggcactggaaggttttaggaagagaagtggcattatctaattttcctcttaaaaggatcattctggctcagtgttgagaacataccatcaagaaacaaagatgaggagattaattaggaggcaatattaatccaggtgagaggatggcagtagaaacagtaaaaagtggtcagacttatcttctgaagtaagtcataaaaccttgggctgggcaggaatatgctggtgccaaccatttttggtcttctgtgctggtactaacaaggaattcccagggaaggagcatccagctggcatagcttgggccatacaaacacactgtgatagaggaaggatggacccgattgcagtctcaccgggccttgtctaagaaagatcattcttcaaaggaaaattcggatggatttattggaggaagttatttaagcagccaaaagaatcaagcagtcaccccaggatagtagaaagga

SEQ ID NO: 106421 - DNA, 350 bp, Homo sapiens
ggagccatggaaggtgattgaggaagggagggacaggtcagagataggttttagagatgactgtggagtgcacctagcagggagctgctaggcttgaaactgacaagtctgagagtttgctctatttacaaactaatgagttaattgtccacatttaactccatacatctacatctatatctatgtctggtctatgtttatgtttttgcctatgtctttctatatctttgtctctgtttgagtttgtgtctctatgactgtgactatgtgtatgtctttgtctttgtaattggccatatctgtatgtctttttatctatgtcttcatctttgtctatgtctacgcctttg

SEQ ID NO: 106422 - DNA, 149 bp, Homo sapiens
tcgagatcacgccactgcactccagcctgggtgacagagtcagactctgtctcaaaaaacattatagctagctagctagctagctagagatagcttatataaaagtcctaatataggcagggcgcggtggctcacacctgtaatcccag

SEQ ID NO: 106423 - DNA, 468 bp, Homo sapiens
ggcacgtcttacatgctgaagcaggaggaatagagagagggaggaggtcctatacactcttaaacaaccagatttcatgacagctcactgactcactattgatatgacaacacgaagggggatggtgttaaaccatgataaaccaccccagatccaatcacctcccaccaggccccacctccaataatggggattacaattcaacatgagatttaggtgagggcacagactcaaaccatgtcaccctacttgcaaaaaataggagttggattatgccatctcttaagaactactttggcgttgtggttttgatttcccaaagaatctttaaactcagaatttggaatgttctggagatcagggaatgatagaaaaatagttggggccttgatcacaaaatggcattttattttctattgaataaaatattttaatgtctttctaataaagtctgacttctgagtgatt

SEQ ID NO: 106424 - DNA, 395 bp, Homo sapiens
actgcagtcactaataacagcagagccgggaggccaccactctcgggccagagttcttttcaaccgctccaagcttctagggttttttccttgccaagggtgttgctaagggtgcactgtgcatgtccaggaaatactgcttctatcatggaataaataaaagcgtgtatagagatatatgtctcctgttttcaagaaactactagccttgctgtccaggtgcctgtgattcatggtgtttgggttgatctaagaaaatagcattaactctggttttatgaaatgaatattacatgcatgaattgtaaatatcagaaggtagatttgtgtgtctgtgtgtgtgtgtgtgtgtgtgtgtgtgtgtaatactaaaaagtataatttcttcctatacg

SEQ ID NO: 106425 - DNA, 661 bp, Homo sapiens
gaaagattagctgagtttttctgctgacttaactgttgaatagcatcatcctcaggcactaccaaaagtgtttagagcactctgttgaaaatggcagtatttgaagaaactggatgtcacttaaaatatgatccttggataaacatcacatgctgctggccttcttacaaaatgagtgtgagtgaagtgcttggctctgcgagatggtcctggaatatcttcaccactcttcacaattacgtcctcttgcattcccactgatccttcagaattgtgtggcctttcaactttctgaaaggccttcactgtctcttaattcaaattctccacatgtaaatacaagtcagatcaccttacaatttaatctttaagcaaaactgtaaatcatcatttcccgcgacattacaattgttgggggaaaggtgtttggtgtcacatctaatggcttgaaaactcggagcatctctggacacagtcaatatccaggtctcaaatatgcatttactgtgtttattataatgactgcctttgtattcactgcaatcattttctactgtttcttcctttgtgtaatcatttcttcccttcccctccattgtatttttttagagtaattctatattctgtttttgaatacacacttctctttcttttaaaataa

SEQ ID NO: 106426 - DNA, 372 bp, Homo sapiens
ctgatattgaaaatgtaataaatataaagtacaaatcccacttaaaaaatttataggacagaattattggtggaaggcaggcagttaagagataatctccctcatccaactgtgacaccatatataaatcttagctattgtgcagttcgtttgctaagcactattcccagataaatgacagtaagttcctaggtctatagcagaaacttttacacttaagtattgcacagggttgtcaaacagattgggcataacaggaagaagattaaaatacttgagacaatataatccatgtgttacagcaaatattctcaattcactaaaaaacagaatctgaatttcatgctcagagtttttcagtgaggaagtaga

SEQ ID NO: 106427 - DNA, 341 bp, Homo sapiens
tgtgaatgggcagtggctcacctcatggtggactgcccaccctaatattcttaaagaaaagaacttccagcacagaatttcatatccagccaaagtaagcttcttaagtgaaggagaagtaagatccttttcaggcaagcaaatgctgaggtaatttgtcaccactaggcctgccttgcaagagttcctgaaagaagcactaaacatggagaggaaaaaacactaccagccactacaaaaacacattgaagtacccagacctgtgacaatacaagcaatcgcataaacaagtctgcaaaataaccagctagcatcatgatgacaggatcaaattcacccat

SEQ ID NO: 106428 - DNA, 404 bp, Homo sapiens
gccaagagaaactgcatgcttgaatattctacagtcatccagataaagaccaaaagaggcatcaagtagcaataataaggatttatctaattttaaacaaaatatcttcttctttctcatcaggatcgagatgaccacagccacccctctgggggataccaccttcttctcactgaacatgaccaccaggggagaagacttcctgtataagagtaaggtcaaattcgcttagaggctgggggaaggatggcaggaccacgttcgcaacacggaagaatgtggactccattcgagcagtagagggacaaaacggacgactaacacacacatcatgtcgtgtccccttcaactatgcacgcaggccacagaagacagcgaagtgcactcacaaccaggccccagcc

SEQ ID NO: 106429 - DNA, 436 bp, Homo sapiens
ctacatactaaaatccccaaggggagaataccttgagtaacataacatttcactggaatcagcgaattaacaccatagtatttgctttattagtaaaactctaatgcattgaagtaagggataggagagaggaaaaacgacactgaatgtgtgaatgactttcctcctattaaaatactaaaagaaattgttgcatcactgtcaggattaatttgagattaaaaaaaatgcaaaaacctcccatctttaacagttctcctttccatcttttgaatcattcattttattttttaataaaaatatcacttaaaaaataatttgggattccccctttttttggtaactagaaagttgcttgtatatttttatgaacccactaaacttaaacagatctctttagaaaaataatgtggatatattttgctttctacagcct

SEQ ID NO: 106430 - DNA, 361 bp, Homo sapiens
gcctactactactaaatttgcaaccgctcgacatttgtttaactcaaacccctccttcacatacagaacctttctgtcactcccagagagttctctcatgctccttcccagttaattcttctccctagcaccaaggcaaccattgttatgattttgtcactggggattagttttctcttttctttctttctttttttttttttaagacatggttgggccaggtgtggtggctcatgcctgtaatcccagcactttgagaggccgaggtggggggatcacctaaggtcaggagttcaagaccagcctggctaacatggtgaaaccccatctctactaaaaatacaaaaaattagccgggcat

SEQ ID NO: 106431 - DNA, 757 bp, Homo sapiens
cgtggtggctcacgcctgtaatcccagcactttgggaggccgagatgggcagatcacgaggttaggagttcgagaccagcctggccaacatagcgaaaccccgtctctactaaaaatacaaaaaattagccaggtgtggtggcgcgcgcctgtaatcccagctattcaggagactgaggcaggagaatcacttgaacctgggaggcagacgttgtggtgagccgagatcgcgctattgcactccagcctgggtgacagagcgagactctgtctcaacaacaacaaaaaaaagtgtctttgtatatctgggagccttgggccacaccagatagtttatgttaataatgtggtttatggtgaatgcctgtttttgtttgcctggggccctgggccatgtttgatcaatttgataaagctaagtgcaggtattccatgcctacatgactaacccccagtaaaagaaaaactctgtactccaaggctcaggtgaggttctccagtcagcagtgcttcgcgtctgttgccacatattgttactgggagaactggggctctctgtgcgacttcactgggagaggacaactgcaagctttgcctgctttctgctagaccccacactccatcactttttcatttgctgattttaatctgtattctttcgccataatgtactgtaattgttgagcaaaatcgcttttctgtgttcttctagtgaattctcaagcctaagagtggccttggagatccccaacgcaga

SEQ ID NO: 106432 - DNA, 960 bp, Homo sapiens
tgaaggaggaagttcaagggcgagagtgagtaccagcagaaggctgggagtctgtagtttgttcctgctgccaggctccactgaggggaacggggacctgtctgaagagaagatgcccctgctgacactctacctgctcctcttctggctctcaggctactccattgccactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacaggcacaagctcctgaagctcagtgtcctcctgcccctcatcttcaccatattgctgctgcttttggtggccgcctcactcttggcttggaggatgatgaagtaccagcagaaagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacgga

SEQ ID NO: 106433 - DNA, 1021 bp, Homo sapiens
tgaaggaggaagttcaagggcgagagtgagtaccagcagaaggctgggagtctgtagtttgttcctgctgccaggctccactgaggggaacggggacctgtctgaagagaagatgcccctgctgacactctacctgctcctcttctggctctcagcacatggagaccagttgccgttgctgttttgatcaacttcaaaggcattcatccagggtggtttattccagaaccactagaaatcattaggaccaccaggacagcctctccacagccatctgatgtggctgcctcagctcgacctcatgagggtcatcagtgctaagagtcaaggctactccattgccactcaaatcaccggtccaacaacagtgaatggcttggagcggggctccttgaccgtgcagtgtgtttacagatcaggctgggagacctacttgaagtggtggtgtcgaggagctatttggcgtgactgcaagatccttgttaaaaccagtgggtcagagcaggaggtgaagagggaccgggtgtccatcaaggacaatcagaaaaaccgcacgttcactgtgaccatggaggatctcatgaaaactgatgctgacacttactggtgtggaattgagaaaactggaaatgaccttggggtcacagttcaagtgaccattgacccagcaccagtcacccaagaagaaactagcagctccccaactctgaccggccaccacttggacaacagcagccgggatgtccccagagcaggtactgcagcccctggagggcgacctctgctatgcagacctgaccctgcagctggccggaacctccccgcaaaaggctaccacgaagctttcctctgcccaggttgaccaggtggaagtggaatatgtcaccatggcttccttgccgaaggaggacatttcctatgcatctctgaccttgggtgctgaggatcaggaaccgacctactgcaacatgggccacctcagtagccacctccccggcaggggccctgaggagcccacgga

SEQ ID NO: 106434 - DNA, 246 bp, Homo sapiens
tgatgaagtaccagcagaaaggtgagaggacctgggtgaggctgggctgagactgggccgggtggctggggatgtggcatctgggagctatctggtccaagggattacccacacaatcaggaaatggcacagtcccaaaggccctcagcagctggcagtgccaggggaccggggggcgccctggagcttgcaggggagccccaggaggttttggcattcgccgcctgccctgcacctccgtccttc

SEQ ID NO: 106435 - DNA, 302 bp, Homo sapiens
aaaagtgcttggcacaaaggagtactcaataaatattgttaattgggccagtatcaaaatgacagtgaaaagacacgacttcaacaagctggtttgggtagtcatgtggtcattaaacaattacattctcatgcgaattcagaatttagctttatagcaaactcggaacataagacactaattccatcttgaaaacctgtaaaaagagcagtaggctctgtcaacgacaaacccaagcctatgcctaattccaggttgaatgagtctgctccttaaataaccctatcattctgtgcctcaag

SEQ ID NO: 106436 - DNA, 179 bp, Homo sapiens
tttagtagagatggggtttcaccatattggccaggctggtctcaacctcctaacctcaggtgatccacctgccttggcctcccaaaatgctgggattacaggcgtgagccaccgcacctggcctctggtctttaatactttctaaaagaaacatttagacagtaactgctctactctac

SEQ ID NO: 106437 - DNA, 287 bp, Homo sapiens
taaaaaacacatataaagcctgcagcagtttccaatatattgtaatttctcaataaatggtagctatcgtttttactatttccttcattcccctagtcctgttgattttacagatcttaccagtttttttctaatttatcccctcccaagttcaaacacctgacttccagcctagcccactgcagttgccccctcactgatatccctgccctccttcttagctgctcctgcccacccactactggcagagagttatttcagaaggccaaatcagtcatcaaacagtt

SEQ ID NO: 106438 - DNA, 1273 bp, Homo sapiens
ggaggattgatcaagaaagtatctatattgaagctaatggaagctggatttctctctgtgggaaaacaaatttacaaatatgaaaaggggaagcgaaaaaaataactcattgctattgttatggtaagaaggaagaaggaaggaaggaaagagcaaaaggaaggaaagaaggaaagagtgaaagggaagggaggaaagaaacaaaaaaaattatcaatgcaagtgaatatgtctgtgtacatatccatgaatacatacatatatttcaaaattctgaccatggagaggacctaggtgcaatgacaccccagtagcaattaataacaagtatgtaggttccaatttccataacaaacaacaaggactccttgtaaaagtggatgattcaaggatggaggtagagaaatttcaagataagcctggaacgttggataataatgaactgtggtttgaatgctggtatttatcgctgtccattttctgatttgaaaggcttggcaattactctgtaggagagtgtctttgggagaagtagtaataggaatatttacagatgataggacatacaggtttcaacttgcttaacttgctctcaaaatattcaaaaaaggtatcatatccttgaaaataccacatctatctatctatctatctatctatctatctatctatctatctatcatctttacaaaaagagatggagaaaatatgaaactattaactgaggaatctggatgaagagaatgtgggagttcattctactgttcttgcaacttttctgataaaaatatttcaaagtaaattatttcaaaattaaatttaaaaactcaatatatgagtttaacaataggttggacactattgaatacaagacttgtgaactggaaacatatcaatgaaaaatatacaaagtgaagcatggaagaaaaaaagaaagagaaaaaataagaaacaaatgtaagagacatacaggacaagtatgaaaggtctaccatgtaaaactgaagtttcagagggcaaggagaaagaaatagagcagaagcaatattcaaagggataatggttgggaattttctaaagcagataaaatacatttaacccactggttaagaagctcagcaaaccctcaagcaggataagtatagagaaaaccacaattatgcaactcacaataaaactgctgaaccaaagacagagaagatggaaaaaccagccagaagaaaaaagacacattatctacaaaagagcaacaatgagactggcagctgtctct

SEQ ID NO: 106439 - DNA, 649 bp, Homo sapiens
agaaatggggtttcgccatgttttctaggctggtcttgaactcctcagctcaagccatccacccaccttggcttcccaaagtgctaggattataggcatgagtcaccatgcccagcctacaacttcctttttaaaaattaaaaaaaaaattgcttggaataaatactgttccaagtcaattcagtacacatacttctttctgtataatttcatgtggatgttccgtaattttataattttcctattctgggcatttaagtgatactgatatatccatatttatatgttatgcttttttggttgagggggaggatattcttaaaagtgaggtttttgtgagtaaacaaaattgagtattttcaaggaaaatataaattaccaaagtgactcaagcagtagaaaatctaaagagcccagaaatcatagaagaacttgcaaaggttgtaaggtctaaaaatctgaagtgttactaggtccatatggtgttcttggtgcagtctgtataattttaaggaaagaacaaaaattaaactgttgtcagtagtttggttagtgaactatttcagagcagatgaaatagtggtaagtactccaatccattttacaaatcctctgtaataccactaccaaaactgttacagatagcaaa

SEQ ID NO: 106440 - DNA, 390 bp, Homo sapiens
gaggtcaacaatggcaaatgcatagaaagttcaataaaaggcattgataagtgtttacttcaggtgatgagcatgttcttgcgacatttagaaaaacagtatcagtaacaatcagttttcagtgtgtttagaaacaaaaaggagacaagaaatacaaaaatcttttttggccagattctgaaaggaaaaaaaaatagaagatagtagctcctggtggggaggcttagaactgatggagatatttcttggataattcatcaatctgagaaagtatcagtagggagaaatgagaaggatgaaacctgcaggaagagtcatagaaatcaataagaaataaggggagatttgccttggaaagaaacagaaaatttcctgtgagaaataaatcaa

SEQ ID NO: 106441 - DNA, 314 bp, Homo sapiens
attttcagcaagaacatcacatgtggtgacgctgtgtatatctctcacttgatgtcagatgatacaaatggtacatacataagagacctgctcctgaaaagataatagcatattagaaacttaggagactcttggtagagatgtatactgggtaccttaaagaggctgttcaaaaaaagctaataatatttttaaggcctaaccctgctcatacccttttacttttattcccataactaaatctgggttggttagttgggtttttgtagaccagtagttctgaagcacccaagctaactcgttagctgttactt

SEQ ID NO: 106442 - DNA, 456 bp, Homo sapiens
aaatgatttgaaaaaaatctctatgacaagaaactcctaattgggttttgaaaaagtctaaagaagtaagtaaactgaccactgtgattcttacttaaatggatacagttctttttgctttttaaaaaccaataattcttgtgaattagttatttttgagaaaaagtatcattttaagttggtataagtaacttggttaaatttgtcttatttaaatttataacttgcaggcacgtgcctgtaatcccagctacttgggaggctgaggcagaaggattgcatgagcccaggagtttgggaccaacctgggcaacatagtgagacccccgtctcaaaaaaaaataatttataacttaaacactattaattttaggaaagaaattttatagatattagcacttcaatttaattactattaaaataattcctttcttctgcaatatttctcacagggga

SEQ ID NO: 106443 - DNA, 408 bp, Homo sapiens
tattatgtgattcatcagttaactaaaacttgtaagtttaaaagtatgtatattcaattttcctagtgcacatgaagacattttacattatagagctgaatgaaaagtacttttagggcctagtgctttgcttaattttaatttaattagtggatgccttcttaaaagtagacttcctattctcttcttgtatttccacaatgctatttgttgaacactttctaccagttcagtacttaacactaagtactttctatagatcttgctttttgatccttattaaaatattttgatccttattgcaagattttataatgcatcattatcattttataaatagagaactctatccccagtatttagtacattgatgatatcagtaaatgtttgtggaatggaggggaggtt

SEQ ID NO: 106444 - DNA, 370 bp, Homo sapiens
ctgagcagctaggactatgggcatgtgccaccatgcctggctaatttttgtacttttttttgtagagaccgggtttcgctatgttgcccaggctggtcttgaactactggacccaagcagtccccctgcctcggcttcccaaagtgccaggattataggtgtgagccaacatacctggtactggcatactttttggacttaaggcattcattttctgtttgtggctctcaaatagcccacacgcctccacgcgttgtacatggactggcacttccaagtctgctttcacgtctggaatatgctctttccccctttcttgacttcttgttgccgcctgccagctacatctcacagcatttggggcaaagga

SEQ ID NO: 106445 - DNA, 720 bp, Homo sapiens
tgtctttcataataagccaggaagcataagtaaagttctcccctgcgttctgtgaaccattatagcaagttattaaacctgaggagggggttgtggccaagtctgaacaaagtgtaaataacctggggaccaactgcttgcaattggtgtctgaaatgaggggcagtcttgtgggactgagcctctaatctgtggggtctgcaataactctgggtagttactgtcagaattgaattcaattttagggcacccagttggtgtccatatagaactggaatattgcttggtgtggaaaacccatacatttggggtagagaaacagtttctcctagaacagaccaagagtgaaggcagaggtttcaatcctgatggctttttggtttctggttttcagtcccaacagccctttcttcccttgagttctgtggcatacagctaccatcttataatacatttttacatttttttaatgctagatggagtgggtttcattgacccaaaaggccttaactaacacactaacataactttttctgttagtgcagtaagtttttttttttagactctggagaatggacatgcaaatcaaattcccaagagaatgctgatttattaatttccatgcagaataactgccagtgggaccagaatactcctgctcacaggtcagcttgttccctgctggtaggaaaatctgcatgggaagccaagttattatga

SEQ ID NO: 106446 - DNA, 671 bp, Homo sapiens
cgtgctgtatgacaagaggaacctgctttctaagtctgctggacacgcgtgcttcttgaatccaaccagacaagcatgttttctcaaaaccacagtataagacaaggaaactgcacagattcgagtgatttttgaggtaagtatgttattggaaaggtgtgatctatatagaaccctgtacatgaaaaggaggagatgccgctatcttggcagggatgatcatgtatttgaaatagtaactcacagcatttggtctcatgataagagtactgaagattatcccagaaaacctaggatgattggtatttatagtaccattgtttcaggtttttatgacttgaggcatctaactatcttaatgctgtactttagtgtttaccaagcagctttctggtggaaacttgaactgcagacactgagtgttttggttttcctccaagttatagttctcattgtaacttaataagttggcattccagcttagtttgagtcagtttcccagggctgggtcctcagaggagagtggatagaattcagttcctctatgagctggggtgctgacattgtgttcctgctgttgactgtccctgcggtgcacgggacagactgtcagctaacctgtcttcatgacatttctataatactcctcagggggttaaccccatctctac

SEQ ID NO: 106447 - DNA, 427 bp, Homo sapiens
ccaggagtgtgccagagccagggaagccagattcctgtaagtgagttctctacctccctcagccataaccaggcatctttaaaccatctgcacttgtatagagcatgagttgaaaatatctcaaagcctgtgcaggggcatttggaaggtgtgatatggccgccaagtaaggaatgcttttctaccgctaagttacttgacaaatccagaaatacaggctttggggatcacccacatagcttcttgaaactaaattttaagtgaaagttacgaaggcagagactggctagaagttcatgagtctacttcctcttcctgggcaagctgactgcattccctggcccccttgcaggtgacggttgccatggatggaaagggagtggaggaaagtgagccccttctggccctgggcgtgaaggctgttctc

SEQ ID NO: 106448 - DNA, 355 bp, Homo sapiens
tagagaggaaatcttgctatgttgctcagagtggtctagaactcctggcctcaagtgatcctttcacctaggcctccaaaagtgctgggactacaagagtaagccactgagcctggccctgagatgatttttttttttttttcatgaaaatacagggcatggaggtgtggaaagacaccttgctttattattgttgttattattatttgtaaagtataattcataaatcacaaaattcaccatttttaagcataccattcagtgtcttttactatattccaaaggttttgcaaccatcaccaccatctaattttagaatattttcataatgccaaaaagcatgcctgtacttact

SEQ ID NO: 106449 - DNA, 403 bp, Homo sapiens
tatttattaggatcttatttttagcatttcattacaagtaataggtttgggtaccttatttttattgtttttactcatcagttatgaataaggcataccttagaaacttgggttaaattttttcaagttataccagtcaacttggtttaaatacaactgtactaacttgctttatcatgtttcctgtttaattggatgagaattacatgcacttattcagttgttctttgtgtttataggaaaaactctgttctcagctacctcattatgtagtattgtgcttgatcccctgccaattgagaagaattcaacacattctgttctttaacaaaagcttggaagcaggcagtcagaggccttgaggaatacaattctctaaggcctgttttccattttactactt

SEQ ID NO: 106450 - DNA, 664 bp, Homo sapiens
atatcgcagccgtgctcatctcttatccacgttgtggtgtggcagagttgaatcgttgtgacagactgcatgctctgcaaagttgagagtagttaccagctggacttttacagaaaattttgtgggccttgttctaaatgatctcagcgcattgcctagaaccatgccacttttctctgatgtgattctgagaaatgctctctcctcatctggcttctctaaatgctggtatgtgggacattgcacgtgatggtgtcctcgtggtctgaagcttgcccacagagccttgggtaagctccgttacattcttctgcgatgtctgtgtaggatgctgaccacctgtggggtgcacagatgccactctctctgggtgccctacagagaaggctgcttgggactccttcctgctgggggctgcagaagagggaggcattcaggcacagtctccagcagtgctggaagaacgaggctgggttgagtggcaggacagcaagtctggggcttccttcccagttagttacgcccagtgctgtttatgctggcactggaacttgtgtctggtgcagggggcattggataacacgttcgcgagctcgcgaaagtgttatcccattttctaatctatacaagcccttgggactcaaggggtgtatgtgagcccaga

SEQ ID NO: 106451 - DNA, 323 bp, Homo sapiens
tttgtaacatacaatgagtaattgatgttacatttttcaaagggcaaaagatttgttaaatcaaaagccgtatgtataaggtagagagtatttcagggagaccagtgtattatctctctggttctatgtagtattctatcttttttttttttttccgagacagagtttcactcttgttgcccaggctggagtgcaatagcatgatcttggctcactgcaacctccacctcccgagtttaagccattctcctgcctcagcctcccaagtagctgggattacatgcatgtgccaccatatctggctaatttttgtatttttagta

SEQ ID NO: 106452 - DNA, 713 bp, Homo sapiens
ggtcaaaaacctgtcatcctcaacccccctcacccactttaagggtatgaaaagagtcaggagttaagaggtaaaggaagaggatttgggatgagaattatttgaaaagggccattggtgtgtttggcatctccctagtgggagcagtgggtgccacctacactttatctcaagattaggggaaagggcctccatggagcttagtatgtgtccctgatctggtggattaaacagacccctgcctggaaaagtctgaaggatgagatgccagtgctggctaagtgtttgatgacgaagcaagggagaggctgggtgcagactccactcctagagtttgtcagggcagagcatgcatgtagaagaactggcctgcatcctggggtgatagagcctgggcaagaggcccggggtttcaaggaggcgaacttcagactcacagtgctgaggaaggagtagagcaaagagccagggagaaaccctcaccccaagagaccccaggtgatgggagatgaggatgggagactgggggaagggaggggaggaaccactccaaggagcatctgaggagcccatgggggaaggaagctgttaaactttgttaaacttttgcccagcagcgcccagtcaccaccaccagaccttaaggactgtctcttgctgctgcttcactcccactgctgtgtccctggaagggtcagaaacggtaaacaagg

SEQ ID NO: 106453 - DNA, 815 bp, Homo sapiens
tgcccaccaccacaaccagctaattttttttctgtattttcagtagagacggggtttcaccatgttggccaggctggtctcgaactcctgacctcaagtgatccgcccgcctcggccttccagagtgctgggattacaggcgtgagccactgtgcccggccatatctttttttattattatttgtaattttagaggctggtcatggaggatttcttgaggccaggagttcaagatcagcctgggcaacataacaagacctcatatctacaaaaaataaaagaataagccaggtgtggtagtgcatacctgtagtgtctgctactcctgaagctgaggcaggaggatctcttgagcccagaatgctccagccactgcactccagcctgagtgtcagagtgagaccctgtctctaaaaattaaaattaaattttaaaaaagaaagttcagtttagctgtcttgatagccgcagttgagtgctcctgagcccgtgtgacaagtggctcctgtattactggacagcgaaggtcagaaacacatttgaccaggtcacttctccggatgagagcattgtctttgaaactctatgctttgtctcctgttaaccacccagctccaacttcaaaccaggctaagtaaccctctttttgttaaaattctgacaagccactcccagtgcaaagcctctgcccagaacctcttctcctaggctcttggcatggctatgccttcttgtcattcaagtctctgttcaaatgtcctctccccagagaggcctttctaagggtgctctggacagtgttcaaactcacaggc

SEQ ID NO: 106454 - DNA, 480 bp, Homo sapiens
ggggtgtgaggaaagccgggaggcaaggactctttgaggctgggatgtgcagtcgagaagccattagacaaggaatgcacagagcatctgtggtgagggttaggaacaatggattcgattgtggttgctgaggaacgggtgacatctgcaggtggaggtgtccagcaggctgctgagaattatggactggggactgagagggaagtctgggtgtgagaagcagcatggacaaacatgcagggaagggcactgctggaagttggggagggtgtgggactgtttaggggagagactgtggtgagtgggggtgagacagaacccgggtcattgcacatttaaggagcctgaggatcattcagggaggagggaggagagactgaattagaagctgaaggagaatgaaaggcataagacaacagaaattaggttctcccttcatgtcacttccaaggaacaagaggatggattttggttgcagag

SEQ ID NO: 106455 - DNA, 194 bp, Homo sapiens
tctagaggatcctgtatagagcataccctatagcgcatacctcatatccgagatttaagagctactcctcctaccccaaccccaggcagtctctcctaaggataggaacatcatcattccaaggccacaccaggggggcactccgcaggccccatcctcaaaagcacccagttaggctccctgctatgtggaaa

SEQ ID NO: 106456 - DNA, 409 bp, Homo sapiens
tggggctacagacgtgtaccaccacacctggctactttttgtatttttagcagagaggggatttcgccatgttggtcaggctggttttgaactcctgacctcaggtgatctgcccaccttggcctctcaaagtgctgggattacaagcgtgagccactgtgcccggccagaaggagtgttttgagaatggctaagagaagataggttgaatagctatgcctacatgtcactaattaacatctcagagatctctgctacaggttgtcgtcctcattttgtctaatatttttccaatggcatgagtataggaagataaacggggaatgttttgaagtaataaaaaaattccatccataaagaagaacaacatgtattaagctttgtgcaccaaacaacacaacaggaagac

SEQ ID NO: 106457 - DNA, 316 bp, Homo sapiens
gctcgcctgcatctactaggcgctcattctgcacgacgatgaggtgaccgtcacggaggataagatcaatgctctcattaaagcagctggtgtaaatattgaacctttttgacctggcttgtttgcaaaggcctggtcaatgtcaacatcgggagcctcatctgcagtgtagaggctggtggagctgctccagctgaggagaagaaagtggaagcaaagaaagaagaatccgaggacggtgatgatgacatgcgctttggtctttttcactgaacctctttttataaagtgttcaataaaaagctgaacttcaatt

SEQ ID NO: 106458 - DNA, 460 bp, Homo sapiens
atgggccctcgggcttgcccacccccatccccagtcatcaatcaccatttgagaaatgcccactgccagggacatgggagggcagagggtagctcgcgggtgcgtggcccctatctcctcaagctggtttagacccttctggctcagcctcaccagattcctaggatgagcactggcttcaaatcccccaagtgctggtcccttcgtgtccccgaaagaggctgctcgcgtgggcaaaggccccgaggcgtcgagtgcgccttccagggcagtgcggaagctccctgccctcctccttcctccccacttctgcctcctcctcccccagtgttcacttgaagcaaattctagtgggctttttttttttcaatactgtttcaaaacagttgttacagcaaataactgcagacgggtctgctggacgcggtggagaggggctggcagctgcccagcacaggcg

SEQ ID NO: 106459 - DNA, 392 bp, Homo sapiens
gatacccaaaccagataaggatacaacaacaaaaaagaaaactacaggccaagatcactgatgaacatagatgcacaaatcctcaacaaaatactagccaactgaattcaacagcacatcaaaaagatcattcaccatgatcaagtgggtttcaccccagggtgcaaggttgattctacatatgcaaaccaataagtattgaaatgatcacatgatttttgttctcagttctattaatgttcttgattctgttaatgttctgttcacattgcagaaaaagcatttgacaaaataatttcagtagctgctgaaaaagcatttgataaaattcagcatacctttatgatacaaaaaaccttcaataaactgggtataaaagaaacataccttaa

SEQ ID NO: 106460 - DNA, 322 bp, Homo sapiens
aattcaagcttctaacgatgtacggggacatgcctgtagtcccagctacttgggaagctgaggcaggaggatcacttgagcttgggaggatgaggctgcagtgagctgtggttgcaccattgcactccagcccgggtgacagagccaaaccctgtcttgggaaggaaagaaggcaggaagttagggagggaaagagaaaaaggaaaggaaaggaaaaagagagaaagagaagaaaagaaaaagatttgatgggcaaaatcctgtctttggaaggaaagaggggaggaaggtagggagggaaagtggaaaagaaaaggaaaaa

SEQ ID NO: 106461 - DNA, 166 bp, Homo sapiens
ggtggcagggcagtcatccagctgaagagattgtgtggagatggttgatggaggacagcgtttctcggctttattgtgtagccggtggcttagaacccctgaagtaaagggcaagcttccagtcttttttctttttctttttttttttttttgagttggagtctcg

SEQ ID NO: 106462 - DNA, 656 bp, Homo sapiens
atagccaacctctgttagcttcaaacttttcttctgcagctttctcacctcccttggccttcatagaattaaagaaaattaaggcctgtctctagattaggctttggtttaagagaatgtagcttgtttgatcttctatccaaaccattaaaacttcctccatgttagcataaatctgttttactttcttatcattcatgtgtttgatggagtaggacttctaattttcttcaataacttttcattttcattcacaatttgatgaaatgtttggtgcaagaggcctagcttttagcttatttcagctttcaacacgccttcctcactaaacttaattatttctagctttgcattggaagtgaaagatatgtgactctttctttcacttgaacacttagaggccactgtagggctgttgattggcctaatttcaatttgttgtgccttagaaaaaggaaggcctgaggagagggcaagagaggaaaggccagtcagtggagcaataagtacagacaaaatatttatggattaagttcaccacactcagcctggcaattttcttaaaaataagacaacagtcaagttgggcacatcattttgactcttcttttcatgaatggtgcttgtaaccatgtgatgatgcttgatagcatttc

SEQ ID NO: 106463 - DNA, 720 bp, Homo sapiens
gcaggaggatcagttgaggctaggagtttgagaccatcctgggcaacagtagcaaaaccctgtctctaaaaacaagcaaacaaacaaaaaaacaatacaaaaactaccactgtgctcggcctctgtcgcttaagtaaatagatggattaaaaccaaaaaggaagtataccccaccatacctatgtaattttacccttctcttcctttgcatatactgtcttatttcctctgcctggaatcccattatttttttctctttgtaccaaatttctgctcatctttcaatgcctagctcaagtctcactttccttccgtaagttttgtttttgtttttgtattcccagtagaattattctctctccctcatctatgttgccatggcactttaaacatacttgttttagagcatatcacattatgttttagttattttattaaacatttgattttcctgctagtctttactgcttggtcaagttttctataactttcataggcttcagttttttcatttgtaagaaaggggatgatagaatttactttacaagatgttgtggggattaaatgagatagtgaatataacatctgatgcagactaggagcctgatagatgttagcgatactgtttctaaaggcgggaactgtgtctcatttatccttgagtctcctttacctagcatagtgcctggcacatagtaagcataaaaagagtatttgggg

SEQ ID NO: 106464 - DNA, 106 bp, Homo sapiens
ctagttgacgaggactctaataactccaggtggtgaatgggcggtggggaatacagttctgtagaaatacagctctaaagcaatacaaacacagagggaaaaaatg

SEQ ID NO: 106465 - DNA, 473 bp, Homo sapiens
atgcataaaataaaactcaccatcttaaccatgtggaagtgtacagtgagtggtattcagcacattcgtaatggtgcacagccatcaccaccgtccatctccaggactcttttcaacttataaaactggaactctgtacccattaaacaataactccctattttccccttcccagaccttgacaatgacccttctactttctgtctctatgaatttaactacagacctcatatcactggaatcatgcagtatttatttttgtgactggcttacttcactcagcatattgacctgaagattcacccattctgtaagcatgtgtcagaattgcctttctttttagggccaaataatattccgcagtatggatattgttttgttcactcttatctcaccagcatctggaatagtgcctgatacacttttttcttttgagacagagtcttgttctgtcacccaggctagagtgcagt

SEQ ID NO: 106466 - DNA, 184 bp, Homo sapiens
ctgaagtgtaagtactactttcccttatctatgtgatgtcataacacaagtatatttccacattactcattactttattcagcaaacatttattaagcatctactatttattaggccctctgctttgtactgaaatgataacaatgagtaagacccaatcccagctttcagggttaaagtttag

SEQ ID NO: 106467 - DNA, 802 bp, Homo sapiens
tagtatcataaacaatgagttttatcttaacagcagtagcttaataacagcaaattcaaagcaggccgaaaacaaaaaagagatagctttagaaaactctacattttaattgtatagttgcaggttgggcatttgagctctgaattttccttgctgtaatttgcccgttcagttttaaaatgtgcacaagaacaggccacaatatgcagctagctgaagtgctggaaaacctggcatgcctttgaacttctacaggagttcctgcccctagtgggtaagttacctattgcactgactttatgaagatatctcttccagtgcccttagtgtgagcatccccacaaaccttatgaaccagttgaatccaacctgaatgcctctccataagcccggagcccacaaatgcattttctccagggcccttggatggagggaatcaggaaggcctcctccaaacccaaggctaggagagatgttccctccggggtccagggaggagaacagaaaggactgagaagaactaggaatgccctcccaaacccaaggccagcaggagggtctcctccggagttccacagatggaggaggcctaaaagaagaaatcaagtctgcaacctaaaagtgggagatcttggattttgatagcacttacccagatcctttcccagcatagtcaggaacaactggactttttcaaagggaccttggctgtacctggtgtcctgggtgacacaggaaaaggaattcaggggctgcttcagaatcccatctttgccagatacgttaactttaaaaaaaaaat

SEQ ID NO: 106468 - DNA, 1076 bp, Homo sapiens
tttcttaatgtcattccacctgggtttgaaggagctgtgatggcgttctgtccacataatgacagaagatccgtggtgggatcacagacatgcaaagggccaagttggaagagaccttcagaatagtggagtccacttgcattgcatatggagagaaactgaggccctaggttcaggggggagggaacaagtacaaaaatcacagagcaacaatgcaggataagtaactacttgctgcccttcctccctctcctagcactcatcctgccactcatctggagtcaaggtaagaagaggaattcaggccgggtgcggtggctcacgcctgtaatcccagcactttgggaggccgaggcgggcggatcacgaggtcaggagatcgagaccatcctggctaacacagtgaaaccccatctccactaaaaaaaaatagcagagcgtggtagcgggtgcctgtagtcccagctactggggaggctgaggcaggaaaatggcatgaacccgggaggcggagcttgcagtgagccgagatctcgccactgcactccagcctgggcgacagagcgagactccgtctcaaaaaaaaaaaaaaaaaaaaaattcattgctaaccaaggcttacatttattgagaggacacatcagacagtcatttagtactcctgatatccccaagcagtggtgaatgttatttattcccatttaccaggttgacagactgagtatcagaaagattaaagtcacttgtacagaatcaccagggcataattgggtttccagctctagaatccctacatttatctttaaaagttttccctagggacacattccaggcatcttcatgagtgaaattagagctgtctgatagcgtatgagccttcgtaaatctcccagtcactgaatctcagaacttgctgcagctcaaggctctgatggtccagcgactgcacatggctctcagggtgcacctgctgccacccccaggcctccttgacccaaatgaggcacacgtcctctatttctttgagagacagcctcagcccatcaaaaagccattgccccttccgtggagacagg

SEQ ID NO: 106469 - DNA, 325 bp, Homo sapiens
tgttttagagccctaggaaaattgctcaagtttctttaattagtatcattttggttgtcaaattttcaagatgaagacattgtgtttcagcattatttaaagctagggcattaaaattagctggggatttttcaagaattactcattatgacccaattttaaaggtattttaaatgtaacatttaaaaagaattattaatgtctgtactctatctctttcggctacaatatctcaaagttatataaaaagttaattgctagccaaaggtttcacttttcactgtgtaaaatataatgtcaactcaattgtctgtattgggaaaag

SEQ ID NO: 106470 - DNA, 398 bp, Homo sapiens
ttgtgaacagagttctctccgaacctgactttctgcagttcctcagagtccccgtacatggtccaagtgccagttgtgttgtccctgcttaaattgttgaattctttgagggcagaactgcttatttcttttgttgtcatggggcccagcaaaataagtatttgttaagctgaacagtgctccagcatgaatgcttatacatatatttctgccttccaaaactttttttaatattactacttaataaatttttattaaatttttttttttttttgtagagatggggtcttgctgtgttgatcctgccagtcttgaactcctggcctcaagcaggcctcccaaagtgctaggattacaagcctaagctaccatgcccagctcgtatttttagatatagt

SEQ ID NO: 106471 - DNA, 654 bp, Homo sapiens
tgcggccgtggttggtgggggggcaggaagctgctggtggagctgcagcatccttcagtctcaggcccctgggagggggaggggaaagaaccagggctgagctgtggagtgaaggggagccatttctctccaccgactgcaacctccgtgctcacagctcacggttcaccagaatccaggggcttggtcggcctaggaatccacaatgctggatattttcatcctgatgttctttgccatcataggcctggtcattctgtcctacattatctatctgctctagtggcctggagctgcggccggagcctgctggagaacagctcagaaggaaggatggagctgaatggccgagtgccctgcttgctgacgcaccggtggatttttgcttctgctgttatctcggctcctggtctctccagtccaacaagaggcctctcatccacagaagcagtcctactgcccagcagacctctttcagagccttccagacatggctgacccctggcaagcaaggggctttttgagctgagaggcacttggctgggacttcaggaattcatggacagggctggcagatactgcatatgtttgagctgtagatgggattgagaacagaaagttgaaatggagacttattaaagttaccgtggagaa

SEQ ID NO: 106472 - DNA, 698 bp, Homo sapiens
tgctgctggagtgagtgcataaccctggattttcatcgctttcagcaatggaacccatcttccttacccctgactctgcttggatttctgtaacgtgcacatttttaaggttaaagtgaaatgtttttaaaaaagggaaaatctcaaaacccaatcagccttccctgtgttattgtcatcattattaatactgaggttgcagaggtatgtggcagagtccctgttgtgctgctgccctgggggaatttgtctgtcgaaaaggggcagggcagcagtggtattgtgaaacctatgttgtttgcccagtgagcgatagggaatataattgctgtaagagttcagaggaaggcagagatggcgagtgaaacgcttcctggaggaagcatcatgcttctgggggtcatgctgagtaagtcagtgtagttagctaggtcagagagcccccacattttttttttttgttttttttgagacggagtctcactctgtcgcccaggctggagtgcagtggcacaatcttggctcactgcgagctccgcctcctgggttcaccccattctcctgcctcagtctccctagtagctgggactacaggcgcccgccaccatgcccggctaattttttttttttttagtagggacgaggtttcgccgtgttagccaggatggtcttgatctcctgaccttgtgatccgcccg

SEQ ID NO: 106473 - DNA, 518 bp, Homo sapiens
agagaaaccctacaaatgtgaagaatgtggcaaagcctttagtattttctcaacccttactaaacataagataattcacactgaagagaaatcccacagatgtgaagaatgtggcaaagcttataaggagtcttcacacgttactacacataaaagaattcatactggagagaaaccctacaaatgtgaagaatgtggcaaaacctttagtgtattctcaattcttactaaacataaaataattcatacagaagagaaaccctacaaatgtgaagaatgtggcaaagcttttaaacgatcttcaacccttactaaacataggataattcatactgaagagaaaccctacaaatgtgaagaatgtggcaaagcttttaaccaatcttcaacccttagtatacataaaataattcatactggagaaaaaccctacaaatgtgaagaatgtggcaaagcttttaaacgatcttcaacccttactatacataaaatgattcacactggagaaaaaccctaca

SEQ ID NO: 106474 - DNA, 675 bp, Homo sapiens
tggtttctccaaggaaatacagaccaattctgtatatgtattaagcatgtcattttgaaagtttatgaatttagaaattaaaagtcaaatgtttgtttttcttttcttccttttttcaaatgaccttaggattttataacagtttagaagctccagatttgaaatctgcagtaagtgtattttggcaatacctaagatagtggaaagcagcacgatagctattcatctggaaagttatgcaggaatataaacgtgtaggggaggttagaccattcctggaaagaggagagtttagttgagtcagcctcaaagggcgggcaaatttgccattccataacaaagttgcagatcagaacaacctcgcagaggaaccctgaaaagctgatgtattagccatctggtggtcaggttgggcattgcagtcattcacttagctgatacccttattaggttttgtttaacttggaatttaaattagttctccatttttgtctaaaaaagcctattcctagttttaacatttttggcatttttgaggggtatggcaggtctggtcactgtaatttattgttgtattgctcatgatgatcctgaaaaaaacttacattagtgaacttggacaaagaagctaaaaagtacttggagagagaaatggagtttgcttttttgctttga

SEQ ID NO: 106475 - DNA, 128 bp, Homo sapiens
actctagacgatcccccttgcgttccttttggcccctccctgcctacctagaatctgcctgaaagggctggagcccttaggagaggggcagtattgggggactgtgctagctttacccccgcaagaca

SEQ ID NO: 106476 - DNA, 395 bp, Homo sapiens
ggttcaagtgattttcctgcctcagcctcctgagtagctgggactacaggcacctgctaccatgcccagctaacttttgtatttttagtagagacagggtttcaccatgttggccagggtggtcttgaactcctgacctcaggtgatccacccgccttggcctcccaaaatgctgggatatttccacattagttgaaatgtggaagcagcatgttttaaaaactctgctgtgatattatagccaaccaggcattctcctttgtttcttctcactcagcaatcatttactgaatttgcttactctttgtttactaggtggtgttaggttctgtgaacacagggaagaatatgacatggaccctgtcttcctggaaattttatgatcctttctaaca

SEQ ID NO: 106477 - DNA, 398 bp, Homo sapiens
ttagtagaaatgaggtcttgctgtgttggccaggcaactcctgagctcaagcagtcctcccacctcagcctcccaaagtgctaggattacagggtgagccactgcacctggcctgatgtgactcttgacctatccaaggctgcatggggtgggctgcttttccaggcctacagttgttgaaggaattgggctactgacttttttccacattatagccaggtttgcacagaaaagagttttgtttacatctggaatgccatttgcttcagctgtcaaccacgtggatcccaatctatttttgattatttctgtattgatgattggtgagacactcattactttgagttatcaaaattacaaatggagctagaaattactcctcttgaaatagcataggg

SEQ ID NO: 106478 - DNA, 470 bp, Homo sapiens
gaatcgcgagtaatagcgatgtccagtttgtagatgagccgcgggatgtcataacttgcaggcccagtcctgggtgacagagtgtgactccgtctcaaaaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagg

SEQ ID NO: 106479 - DNA, 495 bp, Homo sapiens
attaatatcttacaataatgtggcacattggccacgttagtgaagcaatatccatacattattggtaactgaagttcgtagttccttcaggccgttttcctccaaagtcctgtctctgttccaggatcccatccacgatcccatgtggtatgcgattgccatgcctccttacgccccctcggctgtgacagatcctcagaccttccttgtttttgatgacctggacatctctggggagtcctggtcgggaatattgtaggactttttgcacagattctggacgtaacatcagtcaagccaggagaggcagggcagccgagacagaagtggcttgggtttggagttggccagagctaccgtggagtcccatctgccccctagtagcactgtggccttggcaaactaacttcctctcagagcctccacttccccatctgttaaatggaggaagagtctcaaccacgtacttaatcctgtgcgtgaggattaagtgtg

SEQ ID NO: 106480 - DNA, 310 bp, Homo sapiens
tgcaccaaccctgactgatcctgcaagctgagaggtgggaaagtatggagagcctctaatgagttttcagttcagcaaatctagttaccagtccccagatttctgtttgatttttcaaaattatttcaatctctgttaaaattctctgataaatcaataaattgctttcctatgctatcttgcagatatctgatttccttaaaattgttattttgaattcttgatcagagagctaaccaactgtcatgtcattggggtcagtaactagtttggtacctttgtccttttgggaaggccatggctctttgct

SEQ ID NO: 106481 - DNA, 231 bp, Homo sapiens
taaatacttccaaactggtttggaaagcttctctgggctgaaagccagttgattcttatcagtctttttgcatgactgaagtcaattacttcagagcttgaacaactgcagccttggtaaatggtccagtactgtccagtagtacaatatgggaggcttttaaatgctactgtaattggtagtttaacagatgtgttttggttggacaagaatgtaaaagctattttggag

SEQ ID NO: 106482 - DNA, 726 bp, Homo sapiens
ctctcttccattgggctgttcctgagttatatcctttataataaactggttaagtgtaagaaaagtgttttcctgagtcccctgcgcagttctagtgaactctcaaacctgaggaggcggtcatgggaaaccccaaatttgcagtcaaggtggacaaaagtacaggtggtctggggacctgggacttacaacagagctcttaaatctgtggagtctgaggctaactctgagaagttagtgtcaaaattgaatggaattgttggacactcaactggtgttggagaaccagagaacacctctagtgaaggaaataaaagcatttcactccagaatatgcttctttgacatgttttgagatggctgttcagagggcttgcaaacagaagtacccctgcaaagctgtctttcatgggggagttttgcatcaatccagccaggtcttcccttgtcctgatctaggaaagatttaactgagagtcggacacctttaaagatctgaaagaagcatttaccacctatcctctctgatggctgccacctatcaggtttcatctgtataacaagactaccttcacaagccaggcctcctcctcttctttccttccccataatctatcttgccactgtaatcttgatttttggccatgccctgagccccattctttccgtgacctcaagatggtatagaagcttctgcaccccattgtaggcttgggtaaacacttc

SEQ ID NO: 106483 - DNA, 665 bp, Homo sapiens
cactcgactctgggactatgaggcagttcatccacacgctccaaactccagcttattgtaggagaccagtgcctcgatctcatgaggtcatctcgacgcctcagctgtaacccttggagaacctgtggtctctgctcctctgcctgctgacatgatcatcccaggtgcaaaacaggtatgagccactggcattcctgcgcgccagtcttccatcctcttttcctcgagggacccaccggccaaccagatgtgctgttgtcctgagaactggctccacattttgtgagatgtttaaagtccagggaggtcacttataaggaggcacctctgttctccaggtgcacacacaaagcctcccgttatccggtcttgcacgtgcgtccttaggggccagcaccctggctgccttccagagtctgcccggcttttccatcccatctctgctcccgaaggcatcccgctgcggtcctgggcatcttgcacagaagcccctgcaaatacctacttacataagccacgtacacgttctgtgctattccacggtggctcttggtgcaatttgtttttatttcctgcaagcagacttttcttattacttaacctttttggccccacatttctttaatctgcaaaatgtggcaatggaacccgatcagagatcttca

SEQ ID NO: 106484 - DNA, 891 bp, Homo sapiens
gtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaactta

SEQ ID NO: 106485 - DNA, 1597 bp, Homo sapiens
gtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggc

SEQ ID NO: 106486 - DNA, 2354 bp, Homo sapiens
gtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaacttttttcagtttccagtgaaaatgcatgatactcatgtcatggagtcaggcttgggaaaatctatgaaataatagtttgctgataatgatattttcttatggctttgtatagactacatcctcaaaggattttgtgcttctttgcccatagaaggctttttctccctttgtgtgcttttattaaatctgttgaattatattaatattttttgaatttacagggccaattatcttttttgatggattacttagattaggccatgggttcttcctggcctttctttttctcggtcttttaatcatttcacgtttttatctctccctgagtaaagtggcaagaaaactaaaaatgaaagttaaatgggttgatttgacaatgtgtcaagttctgatttagagtttataaggaaggtagaaacgattggccaaaataagatatttggatgaggattatttaagccgtttagatttggccagagacgccagatttagcaaaggactgggttcttatcttctttcattcatgaatatatgccttgggaggacactggtgattcccacagaattaggccaatgatttgccacattaccctttaagctagcccataattccaccagatcccacaccaagtttcagttcatgactcatactgaataaacgtcagttgtaaatgatgtttgaattggtcttcctactaaagtgaaacatcttcttttaagccaagccacatgaatgaaatagcacaatcaga

SEQ ID NO: 106487 - DNA, 2301 bp, Homo sapiens
gtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaacttttttcagtttccagtgaaaatgcatgatactcatgtcatggagtcaggcttgggaaaatctatgaaataatagtttgctgataatgatattttcttatggctttgtatagactacatcctcaaaggattttgtgcttctttgcccatagaaggctttttctccctttgtgtgcttttattaaatctgttgaattatattaatattttttgaatttacagggccaattatcttttttgatggattacttagattaggccatgggttcttcctggcctttctttttctcggtcttttaatcatttcacgtttttatctctccctgagtaaagtggcaagaaaactatttataaggaaggtagaaacgattggccaaaataagatatttggatgaggattatttaagccgtttagatttggccagagacgccagatttagcaaaggactgggttcttatcttctttcattcatgaatatatgccttgggaggacactggtgattcccacagaattaggccaatgatttgccacattaccctttaagctagcccataattccaccagatcccacaccaagtttcagttcatgactcatactgaataaacgtcagttgtaaatgatgtttgaattggtcttcctactaaagtgaaacatcttcttttaagccaagccacatgaatgaaatagcacaatcaga

SEQ ID NO: 106488 - DNA, 1468 bp, Homo sapiens
gtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactatatacaacagaaaagcaaaattacccactaataacattttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaatctagtcca

SEQ ID NO: 106489 - DNA, 171 bp, Homo sapiens
ggtcaatacaagttatctattttatatagatggaataaactgaggttcagaaaggttatataatgtgcccaaagtttcacaggtaataagcagagaatttggaactcagagcttctgctgccaaatactgttctaagatatgccagctaaagtcgattcgggtaccgagct

SEQ ID NO: 106490 - DNA, 491 bp, Homo sapiens
agccctttataaccaatcacaacagtactaatttttgcaagttaacagaggtcatagttttgcaccccaaaatacccctttcttcttctaccactgattctcctaccactgaaggatgtcttccagattgtctttttctgatcattcatcttattaactatcttcatatgatgcacattcactttcaatcttgtccaattgttttattattcctcttctctactgtagtcataggcaattctaaaaagcacaaagtcccctctttttgccctgaccttgagctacagccaggtgagctgtgattatccctacagaaggcagaaggtgttccagctttaatctcctggagtgaggccatgtcccctttcagtaacaaatgaagaacatcttacttcatctaagagaataccctaaaatacaaaatgatgatctcaaagcaggttaacatgcacatataaaataaaaccaaattgtcttctttagagtaattt

SEQ ID NO: 106491 - DNA, 925 bp, Homo sapiens
agattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgttcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagtt

SEQ ID NO: 106492 - DNA, 320 bp, Homo sapiens
ccctgcagaaggggcaggtttgaggatggtcaggagcttgattttggatacttcatcagacctgaagagcatgggtgcacgtataaaaaaaataaataaataagcatgggttcacgggcaagggcgggctgagagatgaacatggaggtattgacattgagtggctgctggatgccatgagcctggccaaggtccccaaggcagtggcgaggaggagatgaggaggtcaaggaggagacagaggatggacccgaaggccgaagaaaatgcctcaagggagtttcaacaccgggcgcggtggctcacgcctgtaatcccag

SEQ ID NO: 106493 - DNA, 1265 bp, Homo sapiens
cagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagaaaaacaagttccttagaggttgtattctttattctccaagaatctgtctgaaacttgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactag

SEQ ID NO: 106494 - DNA, 1211 bp, Homo sapiens
cagcagtccctcaaagacagccctcaatccatgtagggacatctgagtatgcctctttctattgaaatgtcaattcaatcccagctttctcaccaccgttcccctttgattctttctcaattgtctttttgcctttagctcccacctatacatctcatgctcagagattgtacagctagttcctgtcccacaactattaagtggtttattaagtacattaggcagaatgtgcacttcatcaccaggttctagctctggcaaaggagtgctgtctacagcaagatttttgcttttagaattttattaactacatcttttgggttcatccatctacaaacactgattaagggcccctggggcaaccaattgatcagattactaaaaggacttgggaaaaagcaaaaaggtcccattgtactggactgaggattagaagcaattgaaatacaagcctgtaccaagcaagcagcctggccccacacaggtattagcaaatatgtggtaaccaaggttttaggccttggcctttaggtttcctgttttttttttgtttttgtttttgtttttgtttttctgcaacaggttattcttatctcactggctttcactgatcatgtttagaccttctggtagaagaaataatatccagacaggggatgatttggcttcagcaggctgcaggtgttcaaaggttgccatgtggctggcagtggttcaagcccacatttgacactgctgctctagaggaaagataatgatggtaacacagtaataataataataataacaaaaatatgataaagtgaaagagtaagacttcttcagtgtgcttgctcatggcatgaatgctatgtggacagcccaagccatacccagaatcaccttaattccaactttttgaggttcagcaattggaggtggcaattggctttgcattttaaagtatttcgggtaaaggtgaagtgaaggattttcgtctttataatttctgtttggccatggcaaataccatagttgagtatttgcttcaggagagttctttttacagttttacttttcaatgctgaggcatatttctttgagcactgtgcttttatgtgtctttctacaaaggggttattggtcagtggaagaacaaagtacacttgataaaaacattttcaacatacattgagcctaaacagcagttaagttgtctctaaatgaactag

SEQ ID NO: 106495 - DNA, 971 bp, Homo sapiens
cgggcgtggtggttcacgcctataatcccagcactttgggaggctgaggcgggcggatcacttgaggtcaggagttcgaaaccaccctgaccaacatggtgaaacctcatctctaccaaaattatataaaattagctgggcgttgtggcgggtgcctgtaatcccagctactcaggaggctgaggcaggaaaatcgcttgaacccgggaggcagaggttgcagtgagccgagatcacaccacttcactccagcctgggcaacagagcaagactccatctcagataaataaataaatagtcataaaatttgagggcaggctagggaaatgctaacggaatttttgagaggccggcgccaccacggggttcagctgctgtcccagacggtggggggcaggcagcaggggatctacagatgatgaacaacaggagaggcagctgtcatgtggcatctgtccctggaagcttgaggcagcttgggttcaaatccttgctccatttcctctctctttttttttaaccaaagtccagttccaggcttaccacatatcctatttctctttatacctgtgacttcacctctctggatccttaattccctaagtgggatttttaagaggactgttgtgaaaattaaatatattaagtccaatttaaaaaaataaaacaaatatattaagtgctttgaggccaggcacagtggcttatgcctgtaatcccagcactttgagaggttgaggtaggcagatcacttgagcccagcaggttcaatagcagcctgggcaatgtggtgagatcccaactctacaaaaaaataaaaaactagctgggcatggtggcacacacctgtggttccagctactcaggaggctgaggcgagaggatcacttgagcccaggagttccaggctgcagtgagatgtgttcccaccactgcattccagcctgggcaacaaagcgaggagaccctgt

SEQ ID NO: 106496 - DNA, 314 bp, Homo sapiens
caaactggtttcggaagcagattcattcttttcctagccaaagcctggtgaaccgtagtgtgtacaacagttaaaagcagagacctgcaggtccacaggagcagacgctgagaccagcctgcctggggtcaatgccctctaacccctctgtgcctctgctgttcatctgctgaatgggtctcatagttgagcagtggtcgagagatttcctggcatcaaatacatggaagggacttagcgtaggtcctgcttagcacatagtaagtgctcagcgaacttacttaccacttattacttaccacccctgcctgaag

SEQ ID NO: 106497 - DNA, 379 bp, Homo sapiens
tttgaaagagagttttactctgttgcccaggttggagtgcagtggcacaatcacagtaactgtgaactcccgaactctagcgctcccactacatcggccttctgagtagctgcgactacaggcgcatgccaccacacacagctaagttttaaaatttttttagtagagacgagatctcactacgaagcccaggctggtctcgaactcctgagctaatgtgatcctcccgcctcagcctcccaaaatgttgggattacaggcatgagccactgcacctggcccaaatatttttcacagaactgattttctttttttttttttttttttgagacaaagtctcattcttgtcccccaggctggagtgcaatggcatgatctc

SEQ ID NO: 106498 - DNA, 703 bp, Homo sapiens
agccaaatcgagtccagaagtctaaaatccatgcttgtttgttttaaacaaagtagagtgagagatttcgagagaaaggaaaaactagagttgacgatagaacagacaatagaactgaagaataagatggctcatttcgatctccaggggagtgggattttcctcatattggtgaaatatttagttaaaaccacttcatttttaattccactgtcttcaaaacacttttatatctgatatcttgtttttgccttaatctatgagtaataatatgtacctaccttattaattaaaagacaaagagaatgatattgaaaggatactaaagggacctacctaaatgtctgtaatgtgaaataaataagctgtttaatttttgactcctaaactgactcttttctgccagttttacttaatatatgtgtatttcccacttgtgaggtgattgaaaggaaaccttgaactatgctacagccattcagtaagaaattctctataaagagtggcaaaataattcagattattagaatgttgctgtctttatcaaagtcaaagctaattttgttttatgaagccgccaaaagaaaatgcttggggaaactctccaggacatcggtctgggcaaagatttattgagtaataccccataagcacaggcagccacagcaaaaatggacaaatgggatcacatcaagttaaaaag

SEQ ID NO: 106499 - DNA, 770 bp, Homo sapiens
tatatttgaatatattaaggtagcaaactatgttatcttcacataattgtcaaaggatttagacttttcaaaaaaggtataacttcactaatttccatttgtcttttctttgtattgttaaataaagtgtaatcatgtcattgagaagaacttctattataatatcctgagtaagggatttaagttttgacttgtatcattattaaatttctatcccatacttgtaaatactaattgtatgcttttaaacctgtatgttttaaattcagaggtaattgcaataaaagaaagcacacataccaattttcttatagcaaacaactccaccagaatccttaaatctaagatgaagtctaaatatgtcacttagtgcatagaatcccacagtggtttcctgtcaaattaaatacacggtccttagcctgacattttaaatgtcttttaagacaacctcatatgataacaacctactttcctagtatctctcattactttcatttttctctcctgaaagcaagcaggctggactgctttccatcccttagcaggcacaaaaatttttaggcttttgctcagattgctcctcacctctcgcatgccttttcagtggtttttctctctttatgtacccgtcaaaatcctaccccttcttcaaagccatctgcagttaatgaacctcaatgaagtttgtcctcatctacacaaatgatactctttccccacaataccttttatttttctcataggtgttttacccagagacacactta

SEQ ID NO: 106500 - DNA, 912 bp, Homo sapiens
tctgatgaaagcattcttagtgaaaatcttagataattagagtctttctttattcagcatccagatcaatgctgtttcctatactctccaaacaagtggagtcttctagctaaataaagaaaaacctttttaatacttatgaattcacaaatttcaaatttaatttttcttttgttcataaatccctaacactttaatcacgataatccactaaccccatttcagcacttggcttaaccgtggcagtgcaccctaaaccctataagaggcagagcttgtctttttcatctttgcatttccaccatctaatatcatgtatttttaaaaaagaaaacataaactactacttctctaaaacaaaattacaaatgaaaattagagagtaaaattcctcgtcccatgtgcttgaagttgatgctgtacagcctgttcagcccacttgagggaaacagtgttttctccagagtgtgggtcacttgggtctacatggtgtctacatgggtcagcagttgcatggtgaatagagatacacagatgaaaaatggaatttctggctcagagactggacaatcttgagggagttctgagatctagatcaaataagacgatttatatgatacagtaaatgatattatggacatgttgtggaagcacagagggtaaacagcttggatcccctgaaattctgagatttccttgagaaaatggcatctgctgaaccaagaaggcccgtcactatccagtaaattcagtggcacctaagagcctagcaatgccacttcaacctggccagctctggtagagagacaccccaaatgaagtggaatttaatgcatcgtgttcctttggctgggcgtgtccggaggaaaaagaaataggcatttcccatccataagacaaatgctgttggca

SEQ ID NO: 106501 - DNA, 588 bp, Homo sapiens
tagtatcgggagagtccagctgagttcagcatttggacccgggaagcaggcgctggaggcctctccatcgctgttgagggccccagtaaggccgagattacattcgatgaccataaaaatgggtcgtgcggtgtatcttatattgcgccaggcagcctggcttttgttttcggggcttcacaagaggacattttccttgtttgaacatgattaggttgcaaggaacagaaatccatcaggtttgctgcaagtcaatgaggaatctatgtgtatgggcacatgggacagcctcctacaaatccagttgcaagatacatggccagacctcttaagggtgggaacgcttgttctggttgccttttgcctttctccattagcctctctgcttcttgctttcattcaattgctccattctttccaccaaccagcctctgtctgcccacccatggctaccctggctggctgccccagaagagtggccttggcatctgagctccctctagcaggagctcttaaccttttgtgtgccattgactcttgccatctggcgaagcctatggggactgttcttgggataatgttttaaag

SEQ ID NO: 106502 - DNA, 457 bp, Homo sapiens
aaacacttttttttatttacttatttatttagagacagggtctccgtctgttacccaagctggagtacagtggtagagtgctgtgatcatggctcattgcagcttcaaactcttgggctcaaatgattctctcacctcagcctcctgtgccaccatgccctgctagttgattttaattttttataaagaaggagactcattaggcagcccaggctggtctcaaactcctgggcccaagcaattctctcatctcagcctcccaaagcactgggattaaaaacatgagccactgtactgagctgtgcctacttcaaaagactgaaaataaaaaatcaataaatctttgccaaattaaaaaacaaaacaatagtttccaggtcttagacaaagacaattctgtgtcatgaaggtggcaaaaggcttatttagctgttaaaatgatttgcttatatttcaa

SEQ ID NO: 106503 - DNA, 364 bp, Homo sapiens
agccatgtttccaaacgtggctcaggcccattcagcttgtggttttcgctctctctgtccctccgcagggagtgcctgcctcccatgcatcaaggcctacttccaatgcagccctcgtgggcccctcctttagacagaggcagtcttcccccacttagaacaaccacagcactttgattttgtgctttggaattactcagactcaaacaatcattagggaattctatatcttgcctctccgtctagattgagggtacctgttaattcaacttttcattctcccctcctagaatactacaggtacagaaatcatttgctcaattaaatggtggcagcccagttcccatgaggaaggtctgggtga

SEQ ID NO: 106504 - DNA, 322 bp, Homo sapiens
cataaatctacacaaacttctacacaaatgctcatagcagctttattcataataaacagaagtggaaacagttcaaaagtccatcagctgatgactggataaatatcatatatgcatacaagggaatatttttcagtaaaaaactaagttctgggccaggtgaggcatctcatgcctgtaatgctgatgcttgcacccgtgcaagcataggtattgcacaggctgaagaaggaggatggtttcaccccaagagttcaagaccagcctggacaacatagcaagacccctttctctacatatatatagaaaatgttctcaaatt

SEQ ID NO: 106505 - DNA, 250 bp, Homo sapiens
ttaaagtggtttacagtggggtattttttcttactgtctgatatatttggattaaaactaccaccttactatgtgcataccttttgtccttcttgttttatgtttcctttaatctctttggttgttttcttttggattgaatatgttttattcttttaatattcttccttcattagtttggaagctacgttctcttttataattcttttggtggtcagtctagaaactacaatgtgattttaacttgtta

SEQ ID NO: 106506 - DNA, 452 bp, Homo sapiens
agttcctctaaaagcctacaagtccactcgttagattccaacatcaggagatcagcaagcctcaaactcatcattctgaaggctatccttgagcccttccacagacaccctcagaaaatcagcaacttcctaaaagaatctcgtatctaggtactggagtaaaatgcagaatgtacactctctagcttaacaacacaagttgttagcaacaaagctatttctccagacctttatgggaggaatttccccacagatggccagatgtgcaaacaagacctttgagtgcctttcagagcttggattatagaagccagcaaaagtgtatagcaatggagagggattcttccaaataagcctaaagtcccaagccctagatctgaatccaggggtggcattaagaattagagctctgtggcgcatgcctgtaatcccagctacttgggaggctgagg

SEQ ID NO: 106507 - DNA, 764 bp, Homo sapiens
cctaggtgtgcagtaagctatgccatctcggtttatgtaagtacattctatgatgtttgcacaaagaggaaattgcccagtgatacatttcccagagtgtttcctcattgttaagctacacatgactatatacttctttatatgtttaaagagtaacagttttacatctcacttcgttgacaattcttagttagccacagagtgtttcagtgaaagactatagtaaaatactcattcatttggtagaactttgcattttgagaatatctaatccctaatttgttgttaccgtaactgtggaattcctgttttggagagatagtttagtgaactaagagcatggacttcagaggcaggctggttggtttagattccaacttccacgtgcttgttgcaggatcctgggtgaatcacttaaactctccctgcatcaatttcttcatttataaaatgaggatattcaaagggctgttatgagatctatcaagctgatctaaatcatgcatgttcccttgaacagtgtgacacatgggaacactacacgagtgtccattatttcctaacattgtaagtcccttaaatgggtatagtagtgcactctgagcaggatggggaactgcaagaagaggagactgaggcagcctcctagttctcttgttaggactgtgtttgagagttgagtaccctccttttttaagcacattgtactaaatgctgtcctccaggtccaggacttatgagtgagacttccatgttacaagggc

SEQ ID NO: 106508 - DNA, 356 bp, Homo sapiens
ggaagattgaataaccagtgccagggtgggcttcatcctcttatcgtgggaccagctgtcccagtgactttcacttgtcggtactgcagtcctttctggaaaatgtcctgggacaaggatggtgcccagatgtggctgcattaattactgtaaaccccataatgaagaagatgtctccttacagccccctttcagtccttgaatggcctctaggagaaagtctgaatgtgacctccctttctaaaaagcaaggagtgggaccaggaggaaacaggccgcaggatcccggccttctgcaggcagtggggccccaaatatataataatgttgttttgtttcagttatgcttgttttta

SEQ ID NO: 106509 - DNA, 164 bp, Homo sapiens
gctttacaggtcatatagtcccttgcaactgctcacctttgctgcaactgctcacctttgctgccacagcatgacagtgccaataaacaatattgtaaatgaatgtggatagttgtgttctaataaaactttatttacaaaaataagcaacaggagaatttgac

SEQ ID NO: 106510 - DNA, 155 bp, Homo sapiens
acataagatattcagcgaaaaaggatactcataaaatctatctatcagtgtgtcatgcatttctaaaagcaaatataaaatcacgcacaatcaaaactgccctgaagtcacgtcattggccagcgtctggggtcttggaagttcaaaagccccta

SEQ ID NO: 106511 - DNA, 607 bp, Homo sapiens
gggggtcaggtcagcattggaggggatgccagccttgccctgaaggaactagtactcggggagatgcaatgtttattaatgaccgcattctacttagagttttaagaactgccacagaagagatcaagtgctgaggctggccaaagaaaggccagcttgcttctggctgggctgggctgggctgggtctggacctgaggaatctgggccacatcttagaagaagcattagcatttgaacaggaaaggggcggggtgaggggaaacttggcaaagggaaagaacaatccaggtttggggatagcagttcccatgggttactgggaatgcggatggatatgagggggttggagggaagccaggagttccctgtatgcggttttgtggtcttagaagtgtggttccttcaaaatccccactagtggcttgtggaggatggcaactcaggccaggtctttcttaagtgatgcacctgtgcacctgtgatcatttgcagactcaaattactgtagaatttagatgagagtgtgacgttgtgatatccagtgcagtagccacagccacacgcaaatgagcacttgaatcgggtcagtcctaaaatgaaatggg

SEQ ID NO: 106512 - DNA, 413 bp, Homo sapiens
aggagcatttgtgctgggattcaccggtatggattggagatgggggatgggaatggggagatgggtccaagagacagcaccgcaggggtgcggcatggaaggacagggtcccgaggcaaagcaaggcagtggtggggagggtcagggtgctaggctggatgaggcccagtctcagtccttggggcactcctggcatgatgggggagtggcacggaaacagagactggtaatcatgtgtttccaggcacagtggcaggctggccccagggaagggaaccaggcaggctgagagggcctggaaacagactaagcaggaggagatgggagccatggaaagtgctggagctggggtgtgacctgctttggtggctgggcccaagatggacagcctggagggaggaccacttgagggg

SEQ ID NO: 106513 - DNA, 384 bp, Homo sapiens
ccccatggcctttgggtgaatacttttattttagtagatgcacaaacgtattttaattgaattaaagaataaaggaagaaaacatagtgaaggaaaagagcagatatgaaaaagaacgctttagaaaaagtttatttttgctcataattacaaaaaatctactttttctaggcaactaaaataagaaataaaaatatctggactatagcatttgcttttcatcttatatcaggaatgtaatagctatttaaaattctgtgtattactaagggattagtaacgtttgcctcagcctaaggcatcagcatattctagcataatattatttcttaggtaatgtcttatgtcacaatcaccattgcctaattcaaatagaatggtagt

SEQ ID NO: 106514 - DNA, 554 bp, Homo sapiens
gaaaccttccaaaagtggtaaaataaatagctgggctagctaaggtagtttgttagaatataaaatatgaaactgagtatctgtttttgtcatcagaagtgggacatttaggaaagggcagttgttttcctgtaacagttttagtaaatatgaaaataacccacaatgtgggaagaaaactttgtagacaagcaattaagaaaatattcaataatacattttaatccgattttcaagtatgctaacattttagaaaataaacgacgaaaatgggattagggcaactgtattttatatctttgaagcctgaaatagatttgtaattacttcactaatcatcacatttttctaaagctgatggaacaacagcatgtaactcttttgctttactttgtactggaccaggctctcagtgttaaatttttggaaaaaaatcatgagtagtggaacatatataatgataatattatatgcattacatgaaaataatcataaagagactgttatgtggctttcaaggtcagaactttacaaataaatactaaatatatgta

SEQ ID NO: 106515 - DNA, 405 bp, Homo sapiens
ataacattatccctaatttttttttcctgaggaacaaagcaaataccactcaaaagaagcagccataatgcaagcaaaataatttttcccctaaatgctaattctaaatctctttgtaagtacagtcatgcatcggggggataccttctgagaaacaggtcattaggtgatttgatcgttgggtgaacatcatagtatgtacttacacaaacctaggtggtccagcctaccacacacctaagctacatggtatagctgattgctcctagactacaaacctgtatagcatgttactgtactgaatactgcaggcagttggaacacagtggaacacaatggtaagtatttgtattaacttaaacatatctaaacatggaaatggtatagtaaaaatatggtattata

SEQ ID NO: 106516 - DNA, 400 bp, Homo sapiens
ctttcccatctttgaaatatgacccctaaatgttcatccttactgtagaagacaacctatgagtgaagtcctctctctcttcttcactcattgggtatattactggtatatcatttagtgtgtcaggatgggcacagtggctcatgcttgtaatcccagcattttgggaggccaaggcaggcagatcacctgaggtcaggagttcgggaccagcctggccagcatgatgaaggcccatttctactaaaactacaaaacgtagcccggtgtggtggcacatgcttgtggtcccagctgcttgggaggctggggcaggagaatcgcttgaacccaggaggcggagattgcagtgagctgagattgcaccactgcactccagcctgggcaacaaactccctct

SEQ ID NO: 106517 - DNA, 274 bp, Homo sapiens
ctaaactccacagaggagaataaaacagaaacataacatgagtggaaacttgtagtgtccaaatgtcctagtctgacagcacagatatattaaattacttatgatcattgttttggtaaacatttccaagatcagaaatgacaaagttaagtgatacttcttatttctgcttttaaggtatgtctttaaaaaattacttacattgagaatatttaaaaaacataatatgctcatttgatttagagtatttccctttgttgaattgatcataaat

SEQ ID NO: 106518 - DNA, 469 bp, Homo sapiens
agcaaagcagcactgtataaactatacagcaatgcagacatgagaacatctgagggttatagccaagctctttgagaagtagtctctgctgtttaattatggttataaagggcttcagatcaattattctgaagccagaatgatcattagtgacacatctttctactttaattggttaacatttcacatagctttttagctgtagtaactctctgatttataccttttattttgttttttaaaaaatattgccagtcaccattcagtgtgtcaaattcataaccccattaaatgggtcttgactcatttaaacgactgtcaattcagatttccatgtccactaaaatccattttaaaagatgtctaaagcagaggaaatcttcaacataaaaaaccaacaagctaaaataattagcttgctaggaactaataaaatacttttcctagtgccaaagaactatgcttgaga

SEQ ID NO: 106519 - DNA, 308 bp, Homo sapiens
ctgagactcccaagtagctgggattacaggcacccacaaccacgcccggctaattttttgcatctttagtagagatggggttttgtcatgttggccaggctggtctggaactcctgacctcaagtgatccacccaccttgacctcccgaaatgctgggattacaggggtgagccaccatgtctggccgatatttttattttcatctcgaggaccgaaccgcccgtcctaaccaaatcactggtttggcacaagagttctgtgtgtctcatttgccctgtcccagtgcacgtgagggtcagttaatacc

SEQ ID NO: 106520 - DNA, 329 bp, Homo sapiens
ggtgtgtgtgcgtgcatgtgtgcatgtttatgggtgtgtgtgtgtgcatatgtgtatatttgtatgtatgtgtgtgtgcgttgcctgagctggggtgtgagggctcagtccctgtcacagattggtgaggcatagttggggagtcctttgccagaactcaaaggtcatgtgtacctcaaattctccttcctgcctccctgctcacccccatgaacagaaggctcctccccagccctgcggctgctctttgtatccaagactgtgaggcccaccagcgccgggcagcacattgtgttgccagcctgtggaacatctcgctttgcactggc

SEQ ID NO: 106521 - DNA, 1705 bp, Homo sapiens
acccgggctactgcggtgtggactcgagggctgggcgcggggccggcgcagaagccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggagtgcgtgcggcggcaactgagggccacgggccgcccgcccagcacggagcacgcggcaccctggatccccgacaaggccacggacatctgcatgcgctgcacgcagacgcgcttctctgccctcacgaggcgccaccactgccgcaagtgcggcttcgtggtctgcgctgagtgctcgcgccagcgcttcctgctcccgcgcctgtcccccaagcccgtgcgcgtctgcagcctctgctaccgcgaactggccgcccagcagcggcaggaggaggcggaggagcagggcgcggggtccccagggcagccagcccacctggcccggcccatctgcggagcgtccagtggagatgacgatgactccgacgaggacaaggagggcagcagggacggcgactggcccagcagcgtggagttctacgcctcgggggtggcctggtctgccttccacagctgacccccggcctgcagaacatctgtccccaagccagctccactgcccaggcccccaagagggcagctccagaagctgcccagggctccgggaccccatcccatggtggcaggtgcagcggtggggagtggctctttctggactcccagtgcctttttgctggacactgtgtccttatggcttcactgcaggtaatgcctttcccttcaggaagccccagaacacccacaggtcttggtaacaaacgccaccttacactctgcaggctgcagcggcagctccagatggcctcctgagctggacgaccccaggtctccagacatctagggaccagagcaggtttgggaacacagagggaagacaggatgggagtgtagccacagaacccacctgcaccctgacaggcacaccccactgaagagcctgagtcccaggaggcctcctggaagcccaggactgcccacccaccacgctggtgcccaccgcctggccagccaagccctgccgatcagacatgtgggctccccgaagcccagccagagactgccgtgctgtgggtgccaccaggcccagggactgcagcctgagctccccgaggcccagggcagccgggtgaggactctgtcctgtgtcacctctctccaggtgtccagctgtctcatgcctttttgtcctgtcctcagctctccgtgtggtcagcgaaaccattgttttctgttaggactcagttgcaagaacagaaaccctgcccccacttaataataaaaaagaaagtttattgatgggtggttgcaaaac

SEQ ID NO: 106522 - DNA, 1933 bp, Homo sapiens
ccccaccgtcccccggccgggctgcgggtcgcggggcaggcgcatgaggcgagtctcccatcaccacccccggacaagcgagctctctcccgccgcgcggtcttggcggctcctgggccggcggggcgcagtgccgctgactccagcccaagaagaggcctgggaagggcgctcctgggcggcttgcggggtgaacctgcagggagcctggggagagcggtcaggggtcagagcgtccgaggcggaatccccggggaaacgcgcagatgtaagctggtggagccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggagtgcgtgcggcggcaactgagggccacgggccgcccgcccagcacggagcacgcggcaccctggatccccgacaaggccacggacatctgcatgcgctgcacgcagacgcgcttctctgccctcacgaggcgccaccactgccgcaagtgcggcttcgtggtctgcgctgagtgctcgcgccagcgcttcctgctcccgcgcctgtcccccaagcccgtgcgcgtctgcagcctctgctaccgcgaactggccgcccagcagcggcaggaggaggcggaggagcagggcgcggggtccccagggcagccagcccacctggcccggcccatctgcggagcgtccagtggagatgacgatgactccgacgaggacaaggagggcagcagggacggcgactggcccagcagcgtggagttctacgcctcgggggtggcctggtctgccttccacagctgacccccggcctgcagaacatctgtccccaagccagctccactgcccaggcccccaagagggcagctccagaagctgcccagggctccgggaccccatcccatggtggcaggtgcagcggtggggagtggctctttctggactcccagtgcctttttgctggacactgtgtccttatggcttcactgcaggtaatgcctttcccttcaggaagccccagaacacccacaggtcttggtaacaaacgccaccttacactctgcaggctgcagcggcagctccagatggcctcctgagctggacgaccccaggtctccagacatctagggaccagagcaggtttgggaacacagagggaagacaggatgggagtgtagccacagaacccacctgcaccctgacaggcacaccccactgaagagcctgagtcccaggaggcctcctggaagcccaggactgcccacccaccacgctggtgcccaccgcctggccagccaagccctgccgatcagacatgtgggctccccgaagcccagccagagactgccgtgctgtgggtgccaccaggcccagggactgcagcctgagctccccgaggcccagggcagccgggtgaggactctgtcctgtgtcacctctctccaggtgtccagctgtctcatgcctttttgtcctgtcctcagctctccgtgtggtcagcgaaaccattgttttctgttaggactcagttgcaagaacagaaaccctgcccccacttaataataaaaaagaaagtttattgatgggtggttgcaaaac

SEQ ID NO: 106523 - DNA, 1959 bp, Homo sapiens
accggtctcttcccggaggagggccttccaggaatcacagggctggacagagcccaggggcggcccctctggagggagaggaggcttggcgcctgatgctgcagtctcaatgcacatggagaaaacctcacatcctcacgctggcctgggagcctgcaggatgtctcctgccggcactgcaacctcatctgtcctccttgccccatcgctccttcctccgcagcctgacttcacccattccaccttgagctgctccccaggaccggagctctgcccctagatctttgcacagctgacttcaggctggaccgccagctggagacgatggtggaccacttggccaacacggagatcaacagccagcgcatcgcggcagtggagagctgcttcggggcctcggggcagccgctggcgctgccaggccgagtgctgctgggcgagggcgtgctgaccaaagagtgccgcaagaaggccaagccgcgcatcttcttcctctttaacgacatcctggtgtatggcagcatcgtgctcaacaagcgcaagtaccgcagccagcacatcatccccctggaggaggtcacactggagctgttgccggagacgctgcaggccaagaaccgctggatgatcaagacggccaagaagtcctttgtggtgtcggccgcctccgctacggagcgccaggaatggattagccacatcgaggagtgcgtgcggcggcaactgagggccacgggccgcccgcccagcacggagcacgcggcaccctggatccccgacaaggccacggacatctgcatgcgctgcacgcagacgcgcttctctgccctcacgaggcgccaccactgccgcaagtgcggcttcgtggtctgcgctgagtgctcgcgccagcgcttcctgctcccgcgcctgtcccccaagcccgtgcgcgtctgcagcctctgctaccgcgaactggccgcccagcagcggcaggaggaggcggaggagcagggcgcggggtccccagggcagccagcccacctggcccggcccatctgcggagcgtccagtggagatgacgatgactccgacgaggacaaggagggcagcagggacggcgactggcccagcagcgtggagttctacgcctcgggggtggcctggtctgccttccacagctgacccccggcctgcagaacatctgtccccaagccagctccactgcccaggcccccaagagggcagctccagaagctgcccagggctccgggaccccatcccatggtggcaggtgcagcggtggggagtggctctttctggactcccagtgcctttttgctggacactgtgtccttatggcttcactgcaggtaatgcctttcccttcaggaagccccagaacacccacaggtcttggtaacaaacgccaccttacactctgcaggctgcagcggcagctccagatggcctcctgagctggacgaccccaggtctccagacatctagggaccagagcaggtttgggaacacagagggaagacaggatgggagtgtagccacagaacccacctgcaccctgacaggcacaccccactgaagagcctgagtcccaggaggcctcctggaagcccaggactgcccacccaccacgctggtgcccaccgcctggccagccaagccctgccgatcagacatgtgggctccccgaagcccagccagagactgccgtgctgtgggtgccaccaggcccagggactgcagcctgagctccccgaggcccagggcagccgggtgaggactctgtcctgtgtcacctctctccaggtgtccagctgtctcatgcctttttgtcctgtcctcagctctccgtgtggtcagcgaaaccattgttttctgttaggactcagttgcaagaacagaaaccctgcccccacttaataataaaaaagaaagtttattgatgggtggttgcaaaac

SEQ ID NO: 106524 - DNA, 186 bp, Homo sapiens
gtgtgtgggcgtgtgcatgcccgtgtgggggtgtgtgtgcaggcccgtgtgtgcggggcggtgtgtgcctgtgtgaaggggtatgtgtgtgggctgtgtgagcgggcccacgtgtgcgggggggtgtgtaagcccccatgtgtgcagaggggtgtgcatgcctatgtgtgatcgggtgtgtgtggg

SEQ ID NO: 106525 - DNA, 504 bp, Homo sapiens
cagcgtggatgaacttgttaaatgtaaatcagatggctacaccctgattaaaagcgtgcattggcttcctcatccctttaacagaaacccattcctccaggatcctgttgatcgggccttgtctgactcttctctctttccttgctctggcatgcagtcttttgtgttccttgatgccacattagtttttgtcttagggcatttgccatttcctagtctgagaagcactttttgctagtcttgtggctccaagtgatttagcgtcttcagagaggccttcctcaaacctgcttaaaagttacctttcccttctgaacaccagtcctcctgtagcaaagtggttctcaaactgtggttcctggacccctgggggttccctgagatgttttcaggcttctgtaaggtaaatatcatagactaagactgttaggctttttcactctgttaatttttgcactaattgtacaaaagcagttgttggcacaactgctgacatcttagcac

SEQ ID NO: 106526 - DNA, 245 bp, Homo sapiens
atacctaatgtaaacgacgagttaatgggtgcagcacaccaacatggtgcatgtatacatatgtaacaaacccgcacgttatgcacatgtaccctagaacttaaaatataatttaaaaaaaaaaagaaaaaaaataccacgaacaaaaaggacatggaattaacaggcaccgaattccttggtttctctctcaactatttaccacctggaatgatctccacgcagtcttctgtctacttctctct

SEQ ID NO: 106527 - DNA, 320 bp, Homo sapiens
ctgcagtgtcttcacagagagggtaatttaagactaactttgaaggatacgtagaattttgctgagcatggaaggaaaataattccaggtagagaaatggaatgaacaaagtacagagtcttgaaaatgcttggtatattaagagcccttctgtacggagctgatggagaataatgttggaaaggttgtttaaggcaagattgtgaaggcccatgaaatccatgccaagaaagttttaagttgtaccatagaagatagggagccatctgaggttgttttaatcatcacaatgaccaaatcttttctaagtttttgacggc

SEQ ID NO: 106528 - DNA, 471 bp, Homo sapiens
aagggtgctgttggcagaagctgggaaggctcacttgaaaggagagagaagccaagctgaattgcaggtatcaagctctggacttaacatactgcccaaaccccaagtcctcctagaagcccttgagacagatgaagatactgttacaggacagaaaggaaatccatgaaacgactcactgaaaaagaaaactgtgcaggaagggaggccctccaggtagactgtaaaggtacccatggtgggtatggcagtcctataagagggacagcatgcctggctccagacacacacttagagtgccagagaagaacaatgctgaggccaggcgcagtggctcacgcctgtaatcccagcactttgggaggcagaggcgggcggatcatgaggtcaggagatcgagatcatcctggctaacacagtgaaaccccgtctctactaaaaatacaaaaaaaaaaattagctgggcgtggt

SEQ ID NO: 106529 - DNA, 3439 bp, Homo sapiens
agcggggcttgggtttgaatattgtggttgagtctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagt

SEQ ID NO: 106530 - DNA, 3418 bp, Homo sapiens
agcggggcttgggtttgaatattgtggttgagtctgaagcgctgggaggcggacattaaagtgaagtggttgcggtaacctggcctgggcctgaaagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagt

SEQ ID NO: 106531 - DNA, 3281 bp, Homo sapiens
agcggggcttgggtttgaatattgtggttgagtctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagt

SEQ ID NO: 106532 - DNA, 3188 bp, Homo sapiens
agcggggcttgggtttgaatattgtggttgagtctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaaggccactggaaaacgagatcatagacttgcaatgttgaaaactcgtcgctcctacctggagaaaaggagggaggaggaattgaagcaatttgatgagaatactaattggctccatcgtgtcgaaaaagaaatgggactcttaagtcaaaacggtcatattccaaaggaactcaagaaagatcttcattgtcaccatttgcacctccagaacaaagatttgaaagcacaaattagacatatgatggatctagcttgtcttcaggaacagcaacacaggcagactgaagcagtattgaatgctttacttccaaccctaagaaaacaatattgcacattaaaagaagccggcctgtcaaatgctgcttttgaatctgacttcaaagagatcgaacatttggtagagaggaaaaaagtggtagtttgggctgaccaaactgccgaacaaccaaagcaaaacgatctaccagggatttctgttcttatgacctttccacaacttggaccagttcagcctattccttgttgctcatcttcaggtggaactaatctggttaagattcctacagaaaaaagaactcggagaaaactaatgccatctcccttgaaaggacagcatactctaaagtctccaccatctcaaagtgtgcagctcaatgattctcttagcaaagaacttcagcctattgtatatacaccagaagactgtagaaaagcttttcaaaatccgtctacagtaaccttaatgaaaccatcatcatttactacaagttttcaggctatcagctcaaacataaacagtgataattgtctgaaaatgttgtgtgaagtagctatccctcataatagaagaaaagaatgtggacaggaggacttggactctacatttactatatgtgaagacatcaagagctcgaagtgtaaattacccgaacaagaatcactaccaaatgataacaaagacattttacaacggcttgatccttcttcattctcaactaagcattctatgcctgtaccaagcatggtgccatcctacatggcaatgactactgctgccaaaaggaaacggaaattaacaagttctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaataaatccaaaaaaagaaaaaaaaatttgggccgtcgcgcccgcaaaatttaacttcttgggccgccaagaaggacgggcggccggacagtgttaatgggtggtcacaaaaaccggccggtaaacaaggtggtgattaaggcgtaaccg

SEQ ID NO: 106533 - DNA, 823 bp, Homo sapiens
aatatcataaccccccgaccccacgtcactttgccggggaggaagggtcattctacatcaaacagttcgttaactgcagacgtaaattctggatttgccaaacgtgttcgacaagataattcaagtgagaagcacttacaagaaaacaaaccaacaatggaacataaaagaaacatctgtaaaataaatccaagcatggttagaaaatttggaagaaatatttcaaaaggaaatctaagataaatcacttcaaaaccaagcaaaatgaagttgatcaaatctgcttttcaaagtttatcaataccctttcaaaaatatatttaaaatctttgaaagaagacccatcttaaagctaagtttacccaagtactttcagcaagcagaaaaatgaaactctttgttttcttcttttgtgttctaaaaaaataaaatttcaaaagaaaaggttgtcttttaagttttttaaatatttgttgccttttaaaatccctgagtgtaagttaccatggtggcagcttagttttactatgccacaacaagttgactaggacattttagtaaatggtagtgagttaaattatctttattattttttaaaaataagaatttagaagtggtaaaattatggcccaagatgtatttggttctctattatgttttgatacattattttaatcatatatatgactttccttttcaaaaatactttaatgtacaagtgtaaatatatgtgcccataaaatcattgtaaatattatttagtcatcacaaataaaatattgtcccttgctacttgatatattaaagatgtagattttaaagt

SEQ ID NO: 106534 - DNA, 2040 bp, Homo sapiens
agcggggcttgggtttgaatattgtggttgagtctgaagcgctgggaggcggacattaaagtgaagtggttgcggtaacctggcctgggcctgaagtgagtgagaggcacatgaagagaagtattcaagtatttatacagataggaatcaagataatcaacaatgtctgtcactgaggaagacctgtgccaccatatgaaagtagtagttcgtgtacgtccggaaaacactaaagaaaaagcagctggatttcataaagtggttcatgttgtggataaacatatcctagtttttgatcccaaacaagaagaagtcagttttttccatggaaagaaaactacaaatcaaaatgttataaagaaacaaaataaggatcttaaatttgtatttgatgctgtttttgatgaaacgtcaactcagtcagaagtttttgaacacactactaagccaattcttcgtagttttttgaatggatataattgcacagtacttgcctatggtgccactggtgctgggaagacccacactatgctaggatcagctgatgaacctggagtgatgtatctaacaatgttacacctttacaaatgcatggatgagattaaagaagagaaaatatgtagtactgcagtttcatatctggaggtatataatgaacagattcgtgatctcttagtaaattcagggccacttgctgtccgggaagatacccaaaaaggggtggtcgttcatggacttactttacaccagcccaaatcctcagaagaaattttacatttattggataatggaaacaaaaacaggacacaacatcccactgatatgaatgccacatcttctcgttctcatgctgttttccaaatttacttgcgacaacaagacaaaacagcaagtatcaatcaaaatgtccgtattgccaagatgtcactcattgacctggcaggatctgagcgagcaagtacttccggtgctaaggggacccgatttgtagaaggcacaaatattaatagatcacttttagctcttgggaatgtcatcaatgccttagcagattcaaagagaaagaatcagcatatcccttacagaaatagtaagcttactcgcttgttaaaggattctcttggaggaaactgtcaaactataatgatagctgctgttagtccttcctctgtattctacgatgacacatataacactcttaagtatgctaaccgggcaaaggacattaaatcttctttgaagagcaatgttcttaatgtcaataatcatataactcaatatgtaaagatctgtaatgagcagaaggcagagattttattgttaaaagaaaaactaaaagcctatgaagaacagaaagccttcactaatgaaaatgaccaagcaaagttaatgatttcaaaccctcaggaaaaagaaatcgaaaggtttcaagaaatcctgaactgcttgttccagaatcgagaagaaattagacaagaatatctgaagttggaaatgttacttaaagaaaatgaacttaaatcattctaccaacaacagtgccataaacaaatagaaatgatgtgttctgaagacaaagtagaaaagaaggagtctcttcttctgttgcccaagctggagtgcagtggcacaacctcagctcactgcaacctctgccttccggattcaagcaattctcctgcctcagcctcccagctagctggtattacaagcgtgcaccactacgcccagctaatttttgtatttttagtagagatgatgtttcacaatgttggccatgctagtcttgaactcctgacttcaggtgatccatccgcctcagcctcccaaagtgctgggattacaggctgagccactgtgcccggcctggtggcggtggttctaactctggaaattttatagtcaaggctacttactcacccattctttacagacatctggaaatgttggagaaaatgtagcaaacattttttaaaatacatagttaagtgcacaagaaagaaattttaattcctggatgtcagtaacaaaaaggaaata

SEQ ID NO: 106535 - DNA, 677 bp, Homo sapiens
tacctaaatggctgtgatcctgtcttcagttagggctgcactttccaaacccacccagcatctaaacacctgaagggtatcacagtgcttatcactagaggcctttcccttccactcagcctcctccactatcactgtcaccactcctggcctcctttgggaattaacaggaaagaagcagaggatcacactattttctttctctgcgatcctgaacaagtcagctgtctctcagcctcatttatcattaattataaaatgagaatgatggggtaacagtacagccattaggtagaggatcctgctgagagttaaatgagataatatccagagtgcttagtaaactgtagagtcttatacagatgtttgctggtgaaattcatgttgttctggacacacattaactatcttggactgattctttaaggtcttctgaacaagattccagggtaacctcattttattctttcttggttattattaggggtgaacgggtgggtaggtggtgttttaggctttttttttttttttttaattcttacctatgaaaaaaatattttcttatattttagatttaaatgactaccaagaagtttgctgattgctttcattttggtagtagagtacaagatagttaattattatttctctctagtagagattttttaagaatctgt

SEQ ID NO: 106536 - DNA, 337 bp, Homo sapiens
gcaaggtctttatgacctgtatcttgtgccagcctcctatctcattcagtgacttaaaacgccttaaccgtctgggaatgcagcccagtaggtctcagcctcattttacccagcccctattcaagatggagttgctgtggttcaaatgtctctgacaataccataaagataaaaatcatcaaatttaattatataaaatttaaaatctctaagtaagacactataaacagagacagaaagtgaagtgggaaaaaatatttgctgcctatattagttttaaaagcccgatgacgagttagtgggtgcagtgcaccagcatgtcacatgtatacatatg

SEQ ID NO: 106537 - DNA, 252 bp, Homo sapiens
ttatgtgaagacttaccaagctgaaacatttggacttggaagatttaatacgcaatcactgttctcagagatctttcagtctagctagaaaggcaaacaacttcattgctactgtcatcactttgcaaacatttctataacgctataatttacaaagggtgctctcattcttttggtatttcaggaagtattgtagagctggacttaactgacagaaattgaagtacatgcacctggataatggagatactt

SEQ ID NO: 106538 - DNA, 460 bp, Homo sapiens
aatttatccaaggtcggtcagctgataactgatagagatgagcttcatactcaggcttagctgtgggggtgatagttaatattagaaaccaatccgtgttagtgcttcccttggctggttagaatcctggtgcctctggaatcactacaaccccaggcagctggtaggtctcatcctgatagctctcattctagagcagctgggctctctgacaaaggcctctggaaattcagccccagaagttaactgtgagtcccattttcctaaattcaaagaaaagctgacttgcctttccactatatatctaatagaaaaggcctcccagcagggactgtgggtaaatggaagtaaaaggatagcagaaaggaaaggtggagggggtggaataagatgtaacaaaggagtgagaaataaaactacggtagaggccaggcacggtggttcacacctgtaatctcag

SEQ ID NO: 106539 - DNA, 328 bp, Homo sapiens
ccattttctcccagcccctgaactccattcggagttgcctggaaagcatttggtgtgaaggagctggccacgtctacactaatcagctgttaaccctcagaactaccagccgagagaaatcctggtcggccagagcctcagtccctgaacagtccccctgacattgcatggaaattcctaaaaccaacgtcatcattcttgaaacctccctctacaacaccataaatgcccttttctcctgggctgaatgaatggagaccgtttctcccaatttatggggtgatgccagtttggctgggtagttctcataggccctgaccctggcaac

SEQ ID NO: 106540 - DNA, 215 bp, Homo sapiens
gaacctaaactcagatcccctgtcgccctctctcagagcacctgttcctttccttgctggctctccccacactgcttaacatctcttctagaccacaagctctgcagggaaaaacaatgtctgttttattccccgctgtatgtctaggacctacagagtaaaaggtgctcattaaatgttgtagattgagtgaatggtctccattctttaaagtt

SEQ ID NO: 106541 - DNA, 674 bp, Homo sapiens
ctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtaccgggcctcccatctgctaagcgtttttccgttgagccgctccaaaaacactaagctggggacgccagggtgcccccccaccccggctccctggccctatccacacctccacccccaccccaggatcgccatctttaggggaggcctgggacgggggtgttaggtgttttagggccaccgagctcaaacacaaggacccctccccggcccacccagcccagccccaactgacctccatgcctagggaaaaa

SEQ ID NO: 106542 - DNA, 278 bp, Homo sapiens
ccagggagaggtgctggtgtccgtgtaccgggcctcccatctgctaagcgtttttccgttgagccgctccaaaaacactaagctggggacgccagggtgcccccccaccccggctccctggccctatccacacctccacccccaccccaggatcgccatctttaggggaggcctgggacgggggtgttaggtgttttagggccaccgagctcaaacacaaggacccctccccggcccacccagcccagccccaactgacctccatgcctagggaaaaa

SEQ ID NO: 106543 - DNA, 1764 bp, Homo sapiens
gtagaagtacagaagctaggtagtttggtgaggtaaaggccaagagcagcttgtggatctatccttgtacctccttgctgatggtctagcttgtggtttaataccatctacatttcactaaagccaggtcagcagcattgttcctttgtttcttattaggcaatcaccaatatatattggatgcctattttattcacgaagtgttttaccacactggttttgctggtgtttcctacctcctcacacattgtctatatgatttgctcagtaatgtagggataatgttttcagagtccatagtatatataactcctgatcaggtgactagatggtgtgacttaaggaaagaacacgttgccagtaattcagatgtgccattgacacaggaggacccatgcctgagaaagacttttatctgagttactgagattaagatgttttgaagctcccaagcagagggatgctggatctgctgtggaaatctggctgagcagctgcagggacagctgggggtaaagcatccaccctcccccagtttggcgaggatgcactcctcagctgttctggaaggccagacttcttatctgctgtcattgaagcaagaattgagatgtccaaagagaacagaaatgggacaatttaatactagaaaggaataaaagggttaaagtcttgaatgctaaaacttctgaaataattaatttatcctgaaagattagaaaatataagttgaaactttaaatgaaaaagagattcaatttaaaaaagaactttggcaagattgatatctaaaagggtaaaaataataatactgtatcttacaacatggttatcactgttctgagcatttaatgtgtattaactcgtaaaaccatcacaactacgtgaggtaggtgctactgcctttttacagatgatgaaacaggtatagggaggccaagcaaagtgtctgaggacactaggtggatgtgatggagccagaatttgaacccaggcagcctggatgtagagtctctactattaatcactatgggaaggtggtgatagaataaaagggaatgtgaaagtcgaaaaaattaaaaaataaatggtctaaatagtcaataaacgtttatgaggaaatgattatccttccaggacatgtagattaaaaactacgagtttctcatttatacccatcagatggacaaaagcttaaaaatctcataataccaagtgttttagaggatgtggaacaaaggagactctcatattcagctggagaaagtgtaaattggtacaatcactttggagagcaatttgacaaggtgaagatgtgcatactctgcaacccacttctaggctcatatcctctgaactctcaaatgtgtacccaagaagatatgtacatgccttcatgatagcattgtttgtaagagtaaagaaatgaaaacgacctaaatggccatcaataggggaatggataaatatggtatattcatacaatggaattctatatggcagttaaaatgaacgcaatgttgagtgaaaaagcaagtcacagaatgatttgtacactgtgatgccatttattaatgtttaaaaacatgcaaaacaatatgcatatatacagactgtgtattaacaatgtttaaaaatgcatgggcatgttaaacacccggggagtggctggggagagaaggagggaaaagggattggagttgggaggggtggtacacggtgggtgtcaactgtaacaaactactacaaaaagagctgaagtat

SEQ ID NO: 106544 - DNA, 406 bp, Homo sapiens
ggggagtttcaccattggctgtgtcagccaatggcaaggtgtgtgaacagggaactcctgtgttgagcagagagaggaagaagatgcgtccgagatggagttggggaaggcagcacttgcgtgtttgtgtgtccagagaccgggctggtgatgatgagcaggagggagcgtatgaagatatcagatgtgcaaaggacaaaacccccacccaattacaggaccactgagcctcgagctagggaagtcttaaaacagattgcctgggccgggtggattttccctgagcaggtgtacacctgaaaggaaagcaagtgtgagcatgccacagagtcaacatacatcttgtactggcattcttaagatcagcctctacggtgcagcattttcttgcatatgagtttccttt

SEQ ID NO: 106545 - DNA, 780 bp, Homo sapiens
tttggatatctttcatgaagtgtttgttcacatcttttgaactttttgtgatagtggcacaatcacgacccattgcaacctcaaactcatgggctcaagcgatcttcccaccttggcctcccaagtatctggcactacaggcatgtaccaccacgcttggctaattttttaaatctttcttttagacagggcctcgctatgttacccaggcccagtgtctgccacttgcttgttttcttgtctgaaactcttggcttcaagtgattgatcctcccacctcagcctcccaaaatgctggaattacagacgtgagccactgtgcccagccagctcatcttcgaataataacagttttacttcttccttcttaatttttatactttttcccccctttttcttgcttcattgtattgactaggatttctgatacattgttgattagaggtggtgatggaggacatccttgtctttttcccaaactcagggcaaaaaaggattcatagttgtgccattaagtaatttgctagggtttgttttggggtttttttggggggatgggggataccttttatcagactaaggatattcttttattctaatttgttgggaggtttctatttttgttttttgaattcatgaataggtgttgagtgttgtcaactgcttttcttgcagacttgttttctattttaagaatacaagaagcaaaccatgcagccagtgtctgccacttgcatgttttctgtaatgtggtaacttaatattaaagtaaaatagaga

SEQ ID NO: 106546 - DNA, 535 bp, Homo sapiens
tgagatggagtttcgctcttgtcgcccaggctacagtgcaatggcgtggtctcggctcaatgcaacctctgcctcccgggttcaagcgattctcctgcctcaacctcccgagtagctgggattacaggcatttgccaccatgcctggctaatttttgtatttttagtagagacggggtttcaccatgttggccaggctggtcttgaacttctgacctcaggtgatctgtccaactcagcctctcaaagtgcagggattacaggcatgagccaccgggccggtctcgtaaactaggtattatgagattcaattagccatagatttggacatgcccagcagaatcccattatcagctggaagtgatctctataaaatgcctaccacacaacccactgccgcaatagatacttctgacttcctattgacatcaacagttaactgaagaagaaaaagtccggcctggtatataaactgcttggtgaaacatgctggcccatgctgggctggaagtagactgctatggggtatactactt

SEQ ID NO: 106547 - DNA, 361 bp, Homo sapiens
attgtaaaatgacttgctttcagattcttttatgttttatttttaaaattattttcagccagctctcgtggaacagattcttttaaacagtagtttcctaagtgtattttaagtatttaattttgcagttagctttttctcagtggtatctacagaagattcatcataggatgagcttacatatttctgccattggtgtactttatgttcattggcctcatccattcagttcgttggaagagtgtttatctggcgccaacccacagctattcaaattcctttgcagtgctccatcgcttgattcagcagattcttacacagcgtctgctgtgagcatgatactgccctgggtactagagat

SEQ ID NO: 106548 - DNA, 272 bp, Homo sapiens
accagaggtaatgttcatccaaataatccaacacacatgacattaaaacatcaatatcaggtcggacgtggtggctcatgcctgtaatcccagcactttgggaggccaaggtgggcagatcacttgaggtcaggagttcgagaccagccaggccaacatgatgaaaccccatcttgactaaaaatacaaaaattagccgggaatggtggtgtgcacctgtagtcccagctacttgggaggctgagtcaagagaactgcttgaacccgagggg

SEQ ID NO: 106549 - DNA, 287 bp, Homo sapiens
tgcctttatatgctttattttggattttcatttgccttttttttaatattgtcacttagctatgtgtaatccattattaaatttatattggttttgtattgtcacttagctgtgtgtaatccattattaagcccatcgtagtgagttgaataatgtcaccccaaaattcatgtatactaagacctcagaatgtgacctcatttggaagcagcatctttgcagatgtaattaaagatcttaagatgaaagcatcctggttttaggatgggctctaaattcaatgattg

SEQ ID NO: 106550 - DNA, 237 bp, Homo sapiens
tgcactccagcctgggcgacaagagtgagactctgtctcaaaaaaaaaaaaaaaaagaaaaacgaaaaaaaagaagaagcattggtttctgcccattaatcgtcatttatctaagactaaagagtataattatgtctagatcaatctcttctttgagtttgccaacaaactgagagtcgtttgaagtagctataagggattttaaactgattattttaaatcaaaatttaacagggg

SEQ ID NO: 106551 - DNA, 346 bp, Homo sapiens
aacaaagaacagaaatagatccacaagaaatctaactattagaaatacaagaacagacttttaaaataattaagtatgttcaggaaaccaatgaccaataagtggaaataacaaaatcaaaaggaaatgcgaggactgaaaaataattgaaaggaagaactcaatagagagtttaacatcaacttaaacacagctaagagaggattcatgaactggaatgcaggtcaggagagactatctgagctgaagcaaaaaaataaaatgagaagaaaaatacagaaaaaggcatgagtctttagatgatgaaaaaattaatatacatgtaattcaagtcatagaaggagag

SEQ ID NO: 106552 - DNA, 345 bp, Homo sapiens
taatgttcctaaaaaatgaccattctgcattttccctccaatctccactgcctctatttttggaaaaaaatttcatctttgaaaaagcatttaagaccaactttttttcccactctggtgggaaaagaaatattgctgaatgcagaggacaactacatgaattcatactacttgctctggcaatattcccagatccttatcctggagcatttgtggtagttgggaggatggattttctagcagtatatagactgaatgtgtatgtcccccaaaaattcatatgttgaaacctagtcctcaactgtgtaggtatttggaagtggggctttgggaggtaataaggcc

SEQ ID NO: 106553 - DNA, 650 bp, Homo sapiens
gctgtcattctggaaaacattttgaaacaccccttcctttttaaattgctttcagagtctcacagtgtatccttttatccccagcggtggaaaatctttacccttcaaggtagattaggtttttggaaatagccagaagccattcaaagcaacatctgatgaaccacgcatgtcagatgaatcatatttacttttggagtataagagttctgtgactatgtggtattgacactcatttttatcctgtgtggcacctaaattaaatttaaagatagttctttcaggaagaaaggggagccctcatgtcatgttacacagtggtgtatcagtggaattaatttattgtagccttcagaggtgattgatttaaaagacaatattcatactagagtgtagatgtgactaaacagttttacaccaaaacttggaagaagagaagacactggggacaaataggctgaagagtggggttcagttggatgagtcttaaggcatagggaaatggtttgggaagttaaaacatgcaaagagctgatgattgaagcatttagatttagaaagtcatttgttttcctttccagtgtccctcattattaaatagctccttgatggctagaatcctatcctaacagtcatctgctaagcactta

SEQ ID NO: 106554 - DNA, 432 bp, Homo sapiens
tacgcagcctgctgagggctgtgtctggcatctgcttctaagatggtaccttgttgctatatcctctgtaagggagaaatgctgtgtcctcccatgttggaagagacagaagggcaaaaatggcctgggatggcccccttcagcttttttataagacaatattcatactagagtgtagatgtgactaaacagttttacaccaaaacttggaagaagagaagacactggggacaaataggctgaagagtggggttcagttggatgagtcttaaggcatagggaaatggtttgggaagttaaaacatgcaaagagctgatgattgaagcatttagatttagaaagtcatttgttttcctttccagtgtccctcattattaaatagctccttgatggctagaatcctatcctaacagtcatctgctaagcactta

SEQ ID NO: 106555 - DNA, 745 bp, Homo sapiens
gaaacatctaacttacagggctctgcctttttcaattgtcagcttgtttaaacatgagctgtagaaaagacaaaaaactgtcttttttttccccctcaacttttaagttcaggggtacatgtgcaggatgtggagttttgttacgtaagtaaacgtgtgctatagtggcaaaaaaaacttagtcttaaagatgttactgctaactttcatcagattctattcatgccaagaatgaaaatgaatcccacattatgagtctggatagaaaccaaaatgaccacttattataatcgctgtatactcagtgtcatcaattacaaacagatatagacagatgtttttatcaccgatatctcggcatatttcacacagctattgtgaaaataaatttgataatgtatatccttaggtccacttgagggggaatatgtttacgtgtgttttacctattattttatcttttaggtatctgctaatcactttttcttctatttaaaaaagttaatttggctttaactcccttctctaccacctctttatccattttaatctgcctgttcctgtgatgaaatttttaaaaatcagccttaatatgtttcagaggaatgatgcttttgctttcatctagagagtggcagtatgtaatgagtagcatgcttttagaggtataggaaaggcttttgactctatggaggcttccctagtcagggaaggagctgctattcctatgcctggctgaacttcc

SEQ ID NO: 106556 - DNA, 186 bp, Homo sapiens
atctacccagccatcccaccctcatttcagtgtcctcctagaagtctgtatttcagtcaaaaggaaacactggatttcgacgtgcctcatgttcctcagcttgtaaacacagctgagaaaccaaatggttttttggcagctacgtttctgcccctctcttagcacacaagaaaacgtgtctgtgaa

SEQ ID NO: 106557 - DNA, 450 bp, Homo sapiens
cagcaactttccacagcagttcagagcttgggtccttccattaattgcatgcatcagtagtagcatgtggcattttacttttagctgcatgtggctaagcatccgatcgcctctggctttttccacctcctccttcctgtacctagtgtggaggaggagaacttggcactgagctgagctggtgggcgcctggtattcttcctctccatttttggaacagaagggggatttgtccctcctgcttttccagctgtgaagttcatttggcttgcagccttggcagcattaagggaggaggaacgtgtggatttccacaggaaggtggagacaaagtgggagtggggatgagggcatgatatttgttttccaggatctaattctgccctgggtgggtttttgagtctggtattttgcacaatgggatgtagctcctaaagccagaatgtcatc

SEQ ID NO: 106558 - DNA, 335 bp, Homo sapiens
tgcaggtgttcttcagctttcgtaagcccatacagtgtttccaaacatttttgtgttatatataagttgatacatgacacgtgacacgttgaagcagagagaaatttattttgagcattaggaaggacaggaagaagccaaaacccagaatctaaactctgtgcttgcttgcttatttatttatttatttatttacttacttactgagatgaagtttcactctgtcggtcatgctagagtgcagtggcacgatctcaggtcactgcaacctccacctcccagattcaagcaattctcttgcctcacccttccaggtagctgagactataggtgcc

SEQ ID NO: 106559 - DNA, 242 bp, Homo sapiens
cttaaagcccctgtaaactctgaccacactgagcatgtgtctgctgctccctagtctgggccatgagtgagggtggaggccaagtctcatgcatttttgcagcccccacaagactgtgcaggtggccggccctcattgaatgcggggttaatttaactcagcctctgtgtgagtggatgattcaggttgccagagacagaaccctcagcttagcatgggaagtagcttccctgttgaccctg

SEQ ID NO: 106560 - DNA, 273 bp, Homo sapiens
gagagaggaatttagttccttggtgggttaggaagtggtcagtgctacagaaaaaagttgagttgggttagggacaggggtaccaatgggagggtcttgaggcaggctgcagtgctggtcagggcaggccacaggtcaaaggtgaaatttgagcaaagagttgaaacaggaaaaagaattagccaaggctggtaggagggagagagtgatctgggagggacagtgtctagactaaaagtcctgaggtgggaatacgtttgttgcattcaagat

SEQ ID NO: 106561 - DNA, 164 bp, Homo sapiens
gttagcatagggctacattattagctattatatcagttatatattatggttagttggcaggacctcttaataaattgagtagagggtttcagggaaagagaatcaaggatgacttataccttgaataactgggaaatgaatggttctattcactgaaatggaga

SEQ ID NO: 106562 - DNA, 235 bp, Homo sapiens
tagagacggggtttcaccatgttggccagggtggtctcgaactcctgacctcaagtgatccacccgccttggcctcccaaagtgctgggattacaggtgtgagccaccgcacccagccctgccaggtacccaaatcttaccagtgcaaactacaccattctgttgtgttcccactgctggtttaggatttgacttccctgggtctgcccaatcaatagtactccttcatctgctt

SEQ ID NO: 106563 - DNA, 488 bp, Homo sapiens
agttcgcgacgttatccaggaaggataagtggtcacttcataccaatatactttcagaaaatgcatttaagtttattctaaaacacagaaatactccaagataaaacttcatttgttgacatcgcgttgtttgtaatttgatcaatacaaaatggaatttaaatattctaattggcactttagtttattataatcatggcttaaaaatcaaattttatatacatacatagatatatgaaaacaatattattttaaatcaaaccatgaacattaaatataagaaagttactcctggaatgagatgtgaaaggttgagggacagaacactagaaggtcacaaattatgaagaatggtaacattcttggattaggtgtaagttttgggggtatttattacactattaggaaacagcattgttattttactcaaattttagtattccagatgaattgaagaaaactgccaccacacctcccacctcccaata

SEQ ID NO: 106564 - DNA, 341 bp, Homo sapiens
gaatcactggggatgctactaagggtgcctctgggaaagacaaaaacactcatttgaagacctccagggaccccataacggcagaactcggcactgcacggtatctgccaaggttggagaccgcggcaggcgctgggactggcccattgccaggctcgacaggagggcggcggcagcatcctccagccccttgaggacctttccccggccagacttggcgtcagctcaagggtggggtggcaccccggccatctgtcacttaggggctggactcgacgatacctccagtgcgaggagggtccttgctgcgagattccagtcctcgcggcgagacgaggcga

SEQ ID NO: 106565 - DNA, 279 bp, Homo sapiens
tttttccattatttttttctctttgttttcagttatagaaagttctattctgatctcctcaacctcaaagattcttccttcaggtatgtctagattactgatgagccacacaaagggattcttcaattctgttacagtagttttgatctccaacactttttattttctcttagaattttcatctgtctgtttgaattacccatctgtttttttatgttctctacttttttaattagtgcatttagcatattagtcatagttcttttaaattcacagttt

SEQ ID NO: 106566 - DNA, 147 bp, Homo sapiens
atccgctgggagaagaaagaccccctccccattttctaggtatccatatccaacttgcaaggaaagaacagcataaagttaaatggttacatgattagcaggatggaagcttcagcctgaagaaatgagtctacataggccttaaag

SEQ ID NO: 106567 - DNA, 163 bp, Homo sapiens
ctatgctgggttctctcaggtgtgctgggtcctcctgggtgtgctgggtcctcctgggtgtgctgggtccttcctgagtgtgctaggtccttcccgagtgtgctgggttctctcaggtgtgctgggtcctcctgggtgtgctgggtcctcctgggtgtgctgg

SEQ ID NO: 106568 - DNA, 178 bp, Homo sapiens
ctcagttatcctcctacttcataccctccctttggaaacaaacaagaccccagcaatggctgagctagagaaccccagggagccaggataagtgactcagggctgggtctgcccagcagctgtgggctcacctgggggcaggtgcctcgggtctcacttgggggcaggtgccttggtg

SEQ ID NO: 106569 - DNA, 240 bp, Homo sapiens
tgctggggttacaggcataagccatggcactcagctagtttctaacaattttcttaggaaatattgtattgtggtcagagaagttcatctggatgatattaattatttggtctattaaaactattcccttattactggattgggattctatatatgaccaagagatcaagtctgttaatcaggctattcaaagcttctgtatttcttctcatttttatcagctatatcaataatttttga

SEQ ID NO: 106570 - DNA, 546 bp, Homo sapiens
tcaggtggtgcaggaaggcgcggcccagtcaatcacgttcatgccagaataactgattaaggtagcagcccttgaaacagccttgcctgtaggacgtgacctcccagaccctgtctggtgcccgccatactgatgcggggattactccaaggaagcggctccctctggcttccttattcctccctcctccttattcagcctctcaggttttccgcagtcagaacaaaatgcacagaagggattgttcactcatagtgaaaatttattcaggataggtcatttgttttagtgaaaatagaatgttcttgaaaatgttgccattactggaaattatattcctgttctgcaagataagaaacaaagctggcctccagctttctcataaatgaaaagtaaaaatcaaaacaaaacgaaacaaaaggcacagagaacaaccacaacagcgaaatgcttccagccctgcggaaggaggaaatattctgcatacaccattctccatctattcaatgtttctggatttctgtttttgtttagtagagtcagtgg

SEQ ID NO: 106571 - DNA, 354 bp, Homo sapiens
agatcgtaacattgcacttaagccaagatggcaccattacactccagcccgggcaacaagagggaaactccacctccaaaaaaaaatttttttaaaaataaaagtagagatattaactcgattacagaactccagattttaaaaattgctccaaaaattatgatctaagattctataacagccaaagaattacctactaagtgagacaaataaaaatagcatggtgtgtagaaagcagagactcggacaggagtcacctccttggattctaacctgggttgtgccaggtacaagccatgtgacccaaagtactccctagacttctggccttggttctttcctagttgactttca

SEQ ID NO: 106572 - DNA, 269 bp, Homo sapiens
caatcctcccatctcagcctcccaagtagctgggactacagatgtgcaccaccatgcctggctaattttcgtatttttttgttgacactggtgtccttctacattccaggctggccttgaactcctgcgttcaagcaaccctccagccttggccttccaaagtggtaggattataggcgtgagccacggtgcccaacctatgctaaacttttcacatcagatttatatgtgtcctgtcccgttttacttcaccatgattggactcagtg

SEQ ID NO: 106573 - DNA, 386 bp, Homo sapiens
taccatctaggatccccaataccttctctctattttctctaaaccaactgcggtcaagatttcacctccattattccaccaaaactattctcattaaattcacctttcattactaaatctgttggttaattcttatcctaaacattcttgatctatgtgtgcacaacagttgacaccattaatcactttctcttccttgacataggcttcgctaggcttctagcatacatattatgtttgttttcttcttacctccctggttgttcattctcagtcatctttactgggccttcatcttcctcctgacctcttaattttggcatacatcagggttcagctctttgttctcttctctacctgcgctcattcttggtgatctcatctag

SEQ ID NO: 106574 - DNA, 402 bp, Homo sapiens
tgctaatactgtatttttttattgtggggttttatttttagtattttgaacctgcagttggttgaatcagaggatacagaacccacaaataaaaggagccaactatacttaaattttccacattagaagctgggttccaataagaggaattctaaaaatagcaaacgtactctaaagcagttagttgaaggggcaggttgtgggtaaaaacctttttcagctagcatggcttgccattcaaggctattctgctctaagagacagtggagaaaaaaacagatggacaaatgatctgatcaagctgagttcagtgccattgtttgaccaccacgcctccttatgatagtaggcctctgcaatcacacttgtttatgcatctcaataattaattagtctgtgatt

SEQ ID NO: 106575 - DNA, 343 bp, Homo sapiens
ttcttaattccttataatatgagaaggatgtgttccagccgcactggagcgggaactaaatgcctgtttttccaccagcacgaacgccttcccagtgcatcattactcccctccccattactctcccatagcgtgcaatggagaagcaccatacacaccgccgtgggaggcgagattgtgggctttggagtaaacactcctgcggtccaatcccagctctgtggccctggctgggaaagccagtttacctctctgagcctcagttgccccatctgtagaatggggcccactgcagggaccgggatgacactgtccagctgcctgctgtaccctaagtgcccag

SEQ ID NO: 106576 - DNA, 112 bp, Homo sapiens
ctaaaggactgccgaggaccttagcccaaagctctctgcccactctctgggtctgagtgattgacgatgtcgggagtgtcactgctggaaggaattcaggatcagaaccact

SEQ ID NO: 106577 - DNA, 495 bp, Homo sapiens
gaataacaagtctttatttttttcatcccaacttctttcttgcacatttttcttctagctatatttaatatctgttctccccacacacttgctaatctacatttcacaatcttcttccacttcactttgtctgcaaagaaatctacctggacagaatagcatctctttttttccccctgacccttggcatttcctctccctccaacttctgcctgatcctaggatggactctctcatccctcattctctatcattagctctcaggctgcccttcctgcactttaccttcccccacaccttcttacaggaaagcagaatagaaaggcatcagtgagggatgaacaggagagtgccttgagagaagattcccaggaagacagggagagccagacagtggactggttgcaacccatgtagccgaatcatagtgctcattgctgtggaggctctggtctgtctagccacacagaccagtgaagtgagggtacataggtt

SEQ ID NO: 106578 - DNA, 330 bp, Homo sapiens
gtttgaggtgctcgttgggataagtaggttgaagtattctgtaagcagttaggcataagggtctgagcttctgaaacaaatttggacgttagttgaaagcatataaatgggtaagactcttcgggataagtgaagaattggagacagggaaacagtccagctggactcgcagatttagagatgggcagtggcatgggggagcaggataagaaaagtcggcgaggtaagaagaaaaacagggcgacattttgaaagccaagggagcaagtttgaaggccgcctcctggaggtcaagaggaggatgacaaatctattctagcctcggtcaaa

SEQ ID NO: 106579 - DNA, 441 bp, Homo sapiens
ctaaatcccatcctctcctagctatttaaggaccccactcctgcaatggtcccattttctgcattgccaaatatgctgtgatattcccaccttaaaatgcaaaacaaaaaagttccaccatcttcaatcctacattgaagctatgtatctcactttccctttagctacacctccaagaaagaactgtcctataatgtctccatttctggttcttcccattctctcttcaacctactccaattacactgttgttactgccccttcattgaaagctactcttatcatagtctctaaattcaatagtaaatactgaattatcatcttatcctatttaggatatgactatattgtttctcttactttgaaatattttttctaactttcaagattcaattttcctcactggttgctacttcttaatcttctgtgctacattctcct

SEQ ID NO: 106580 - DNA, 700 bp, Homo sapiens
agtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaac

SEQ ID NO: 106581 - DNA, 234 bp, Homo sapiens
ttactgtattttacagaagggctaggctcattgtgattctatgtgtgaactccaagacagtcactgcccaggttcatgagactgcttctagactaaccctacagccccgtccaagtgggagcatggcaattcagaattctaagcggtttcttctatcttttcttactgttataaagggaagatagaaattttctttccaaactcttaagaatgctatggaagaggctcatagcc

SEQ ID NO: 106582 - DNA, 316 bp, Homo sapiens
aggacagtgaaactcctctgtatgatgctgtaattgtggatacatgccattacacatttgtccaaacccaagaatgtatgaccttaggagtgaaccataatgtaaactatggactttcatgattatgatatgacaaagtaagttcataaatttttataaatatactcctctgatgggggatattgatagtaaaagaggctctacatctctgtactttatgctctgtaagaaatctctgtacttgatgctcaattttgctttgaatctaaaactcttcaaaaatatgtctattaaaaataatcttcctctgagtttt

SEQ ID NO: 106583 - DNA, 583 bp, Homo sapiens
ttctaccttataaataataagcctttgcggtggagggagaaagattttctgagactgtgctggtgaatattcttagcagaaagcagagttaacaagtcagctattccttctgtgaggcttttctcttgaattttagtggcagtgctttttgacttgtcaaagcctggggagtaaaagtggaaggtggtggctgtattgggaaggggacagtctgggtgatgagccacccaggttccagctgtgtctctgtcacctattactcatgtgactttagataaactgcatttcatctttctgagtctcaaagctgagtcaccaatcactcatgtgactttagataaactgcacttaatttttctgagtctcagatccaccatttacatggaggccattgaaaagagtttgaaatgtcataggattcttcagcaaataaaagggaagtaagatgctactcttggaggaaactgggtgaagggctcctgagattgactctatcaactatttttgcatcttcttgtaagcctacattatttcaaaataaaaagttgaaaaaaagaaaatgaaatataaactttttcagata

SEQ ID NO: 106584 - DNA, 459 bp, Homo sapiens
aagaagactgtaattatatttcctagtctgaaataaggtttaatttttcagtttcaatttaggatttactagagacagttatatgtatctattctctagttttgaatttgtaatattttcattgtcttctattatacaatagttcgtctttgtaaatgttttttctcctgaccacaaaatggagtatggctgagcattaattcctgtaggtttttggagtcattatagctctcaagaaaataagcagttccattactaggattaatcttcagtatctgagacaatgaagccagtatttatcattttaaaatttatgtctgggttttcttcactatttgtgcttacatcacaaagccagtaccatttattaagtgccaagtgtagatgaggcaatgtaatcttaggtgctctaaaactctttgagctaggtggttgtgtcccttatgatgcatgtatgtg

SEQ ID NO: 106585 - DNA, 662 bp, Homo sapiens
gatacgatatacataaattcttcaatgtactcttgaatagagaaatactgctatagaaattaatagtttaattccttcattatataaatttggcttctgctcagagagcataattaggttgccgaaggtcataaaatggcagagcctggacattataagaacctaagtcacttaattcaacccacagcttttctggtttgatataaacagacatatatatgtatattatacatgcacaaatacgtatttatagaagcatatacttagtatcagatgtaataatcttttaagcaaaaagcctgaaagacaagctacctttgagtaactgaccactgatttcccaacagattgtctctttgaggatttgttatattacggtaaattatggataacacctcttggtctgcctgccttggaaatagcataacaacatcacaatatgtgaaagttttaaaacctttatgctatttttatgttagatctctcaactggagagtgaataagtgtgtttcttttctcctttatatctcctcaaatttaaagttggctgtttcttttagttatgaactctgaatgaagtaaaagttaataattttaatgaaacaaatattttaatggggcttctacccacaatctggagcacctggataatgcatctacta

SEQ ID NO: 106586 - DNA, 354 bp, Homo sapiens
gctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggccctgaggagcggccctccatgctggacgagccccccttgcctgtgggtgttgaagagccagcggactccagggagccgcctgaggaaccaggcctgagccaggaaggggccatgttgctgtctccaga

SEQ ID NO: 106587 - DNA, 3147 bp, Homo sapiens
  misc_feature (447)..(447): n is a, c, g, or t
  misc_feature (816)..(817): n is a, c, g, or t
  misc_feature (821)..(821): n is a, c, g, or t
  misc_feature (890)..(890): n is a, c, g, or t
  misc_feature (953)..(953): n is a, c, g, or t
  misc_feature (957)..(957): n is a, c, g, or t
  misc_feature (965)..(965): n is a, c, g, or t
  misc_feature (974)..(974): n is a, c, g, or t
  misc_feature (980)..(980): n is a, c, g, or t
  misc_feature (1696)..(1696): n is a, c, g, or t
  misc_feature (2246)..(2246): n is a, c, g, or t
  misc_feature (2402)..(2402): n is a, c, g, or t
tgcttatgaaggcttggaaatctagtgtatattttacactaacagcatatctcaattgagatggccacatctcaagtgcccagtagccacgtgtggcctgaggccatgactctgggcaatacagctttaagtgagtctagggcagggcagagggcagcacctgggatcaggtgtggagcctggggccttgtttagcaccctctggtgagggcactttctttccataaaacccaggtcaagcatgcctcacaaaggggacagtggaagtgcctcagtttacttgggagcttggcctctccagcttgccttcctactgcctggaagaagattggtgtcctcttgccttctctagcccctttcacaagaaccctcccagaatttagtcctatgaagggccaggggtgcaaggagccacccacacaatgacaggacccaccagcaataccngaagttggccagccctactcatccaaattcccttctgccagctgaacatcacaaggatttcagactgccatgctgtggcaactccattttagggtctgggcatgtaaggattactgtattaatccattctcactctgctaataaagacatacctgaggctgggtaatttataaagaaaaagaggtttcatggactcacagatccatatgacaggggaggcctcatgattatggcagaaggtggagaagaagcaaaatcacatcttacatggcagcaggcaagagagttgtgcaggggagctcccctttataaaaccattagatcaggcagggcacagtgactcacatctctaatcacagcactttgganngccnaggtgggtggatcacctgagatcaggagtttgagaccagcctgaccaacatgttgaaaccacatccctnataaaaatacaaaaattagccaggcgtgatggctcatgcctgttgtcccagattcttgggagnctgnggcattanaattgcttnaatccnggaggcagagctttctgtgagctgagatcatgccactgcactccagcctgggcaacagagtgagactcggtctcaaaaaaggaaaaaaaaagaattagatcttgtgagacttattcaatgccatgggaacagctggggaaagacccagcccatgatttagttacctccaactagggccctcccacagcatgtggtgattatgggaactacaattagtgattttggtggggacacagccacaccatatcagttactgagctgggcatcttcttccttgaatgcatattggcctctgaggcacttcctggttaacctcattccacagctgagaaaacccaggcttggcacaggcaagggatctgacccaacgtctcccatcttattagtggaaggaccaagactggacccacaactgtgctcctgttttgagtcaccatgctgcccccaagatcagatctcaaaacaagcagacatgggggctcagaaagtccccagcctagaactttcctgtcaacccaatgacactaaaggctaagctggctgcttattcttctggattcacactagaatgaccttggggtgtgtttcacacatgccgatgtctggagattcacccccagctaactgactatgaatctctgggttggggcctgggcactgatattcatgcagagcttctgagatggtcctattgcattgccaaggtcgacacctgnagaaacattgcacactttttcattcatttagttattaaataggtaatatttattattatttttccagacacggaagcgttgcaagaatagtacaaagacatccgttatacccttcgctgagattccccagtgctaccattttaccccatttgctttattattttctaagtggcagatgagttatcctttacccctaaatattcctgtgtattccttaataacaaggactttctcttatctaaccaatgcaatgatcaaaatcaggaaactaaccctgctacaatacggttttctaatgtatggacctcattcagatttcgccagttaacccaatgatgtacattggagcaaacgatcatcccagatcatgcattattttcagttgttgtgtctctgtaggtccctttcaaccaggaacagctcctcagtttttctttatctttcatagtattggcattcttgaagaacgcaagacggttatttgatagaatgtcccttactttggacttggctgatgtttcttggcggtgatattcttatgcatttgggntgggactatcacagcaatggtgtcatgttgtctgtgcatcgcatcaggagggacatgctgatggtttaccccattacaccaaagtgaatgttgatcgttcagtgaaggtgggcgcaggatcattgcattatattgcagaagccatcatcagccatnctcgctctgattaaccgatcatcttacgtagccatttatctaacaaggctgtaagggtcttgaactcagggtaagcaagccttaaagcagaagagaagaaagaaaggaaggcactggaacctggagctttggcaaagggggcaggtgtggggaacgcaccaccaaagttgttcctggcattaggatgaagaggaaggagaacattctatctagaaggggtttgaggttagccaagctgttgtctcatctcctaaatgtctgccttccccagcatccctgcccgcagttcccgcctcggtagcccctcctgagcctcagtcaccacctgtgctgatgaattgctgttcgccctcctcccaggcaggatgccccatggtcactgcaggctcagcccatccacaacagattcacaaagccggtccctcaatgctggatttcctagatttcccagccaacagtaccaccagcttaaaaccctgcagccatgcctaaatcctctatcttcctgtaccccacttccccacgaccaacccttgctgattttatggctaaatccctctcttggcagtcaggaccagctgcagaatttgcaaggcccagtgcaagatgaaaatatggaccccctcattcaaaaatcagaggaaaagcactgctgaagtattaccatataaagcattttctttcttctgtggtctctgcgtctcaatttatcatgatgctttcatttgttatttaatgtccaagc

SEQ ID NO: 106588 - DNA, 303 bp, Homo sapiens
gagactactactactaaatttgcggcccatcgacctgaggccgagtgtggtggctcacgcctgtaattgtgccactgcacttcaacctgggtgacagagcgagactctgtctcaaaaaaaactcaactgaaaaaagtggaacaaaagaaaaagaaccatgataagtattttgcactttttttttttttgaggcacatttctactctgtcacccaggctgagtacagtggtgtaatcacagctcactgcagccttaactgcccaggctcacgcagtcctcctacctcagcctcccaagtagttg

SEQ ID NO: 106589 - DNA, 359 bp, Homo sapiens
tgagacagagtcttgctctgtcgcccaggctggagcgcagtggcgcgatctcggctcactgcaagcttcgcctcccaggttcacgccattctcctgcctcagcctcctgagtagctgggactacaggcacccgccaccatgcccagctaatttctttttgtatttttagtagagatggggtttcacggtgttagccaggaaggtcttgatctcctgacctcgtgatctgcccgcctcggcctcccaaagtgctgggattacaggcgtgagccaccacgcccggcctgcagtgattctcttaattcagttttgttaaaagcaaacatttggggtctttttttttaaattaattaatttat

SEQ ID NO: 106590 - DNA, 408 bp, Homo sapiens
tattaatgttaaaaattgttgacgttccatgcagtgtgtttttctaattagagccaagctgcagagtaccatttccataatcaacatgggaacggaaactcagcaaaatttcatgtatttgcaatgaaactgctccccggcaacataaaaatggcttttataacataaaggctgtaattagaataagtcaaatcagttggaaacgattaaggccggagtaggcaaagctgccttctaaatatttgtctggagattagcctactcctgcagctctgagaagcatctttgatttacttatactgctcgacgtggcaaagataatcttgtggaaggcaaacgaatacagatttagatgtgctggtcggccccttctgcaacttgacaggaggcagtccattggaagcaaag

SEQ ID NO: 106591 - DNA, 369 bp, Homo sapiens
aagaaaatagtaatgataaaagcagcaattaatgggatatagaacaatagagaatagaaaaaaacggaaagttctttgaaaagatcaataaaattgataaatcaggaaaaaagatactaattaacaatattaggaactaaggaatatcactattgatcctacagataataagggaatattttgaaaaacgatacgaatacattcaatgtcttagttgaagttagtaacttccttgaagacaaactaccaaaactcacttaaatacagaaccttgggtgggcatggaggcttacacatgtaatctcaacattttgggaggccaagagttcaagaccagcccaggaaacataatgagacctctctacaggc

SEQ ID NO: 106592 - DNA, 600 bp, Homo sapiens
gtagaccagattatcaaaaattctcatgattaaaaaggaacatatcaagaaattaagggaaatgaacacagaagcagaaaaattgtgacagaactcaaacgtggcatttactcaagttaaatggagagaaagaagcacttctctaaagaatttgaatgtactatttggggaaagttaaggtttttttctgcttttggtaagagtagactaggtaatttggattaaccttcctgctgtaaataactgtttcctctggaataaaatattaaaataacctgcttgaagaacactggagcattaacaaggcattaagaaggcctggcgcggtggctcgtgcctgtgatcccagcactttgggaggccaaggcgagtggatcacttgaggtcacgagttcgagacaagcctggccagcatggcaggaccctgtctctactgaaaataaaaaaaattagctgggtgtgataggtgtgcgcctgtggtcccagctgcttgggaggctgaggcaggagagtcgcttgaacccacgaagcagacattgcagtgggccaaggttgtgccactgtactctagcctgggcgacagagcgagactctgtctca

SEQ ID NO: 106593 - DNA, 711 bp, Homo sapiens
gatcctcttccttacattggatgagaaggtacgtatgtttgtagtgacaacctgaccgacgcgcctgcgtgcttgttttgcttttgcaacagtgttaactacctaaaggagatctaaatccggagcgttttgttgttttgtttatctttctctttcagttttagatcgctaaggcattttagataaggcaacagctgagtctggtgaagggaaaccgcccccccgcccccgctctgatagagctggctttctgagaaatcgagttcaggctgccaagtatcctctcttagtcgcttcatctcagaagttaatcataatggggtaggccctgggcatttccttttgtgaatcagtttttacatagttttatgcacactaggataactattcctggctaaaagtttcagcgttaatgttgccattcttagtgtacagaattccagtttcataggtgtaattcttttgcgggagaaaggagcaaaaataatcagttaaagctacaagattgttaaccctttcctttaggaggttgttttgaatattgtttccccagtaattatactgagcaaaattcagttcgattctcattcggtatttcctttcaagaccaataaaatagactcttttcggggagggtgtacattttgtatttttaacttttctttatgttccaaaatatttctcctctcacccgcccaatgaaatcaggaa

SEQ ID NO: 106594 - DNA, 335 bp, Homo sapiens
gctatttaaacttaatcaattaaaattcagttaaattaaaattttagctttggctgcactagccacatttcaagagctcaacagccacatgtagctactggctactatattagcgtggacacagaacacttcccccactgccgagagttttatgggatggcactgcctgttacttaaggatggagaaagtaaggtccagagaggtgagagaatgggagtgtgctgggaccctagtcccagagcctgctagcacacagcccggtggtccacccaacagcctccctcgtgatagcaagaagcgggacagagctaggcgtggtggctcatgcctgtaa

SEQ ID NO: 106595 - DNA, 760 bp, Homo sapiens
agccatagtttgcaaaattttgttctaaacagtaattccttcactggagattttaaaaacagaaagagaatacagacagctatacatgttctggtctattcctgttctctagtatagcagcaccttaaaattgtattactaacagagtacaggagattgtatggaaggcctatagtgatgactctttcatcagctttgttcgtaataaattaactgtatgtgtttcagagagtcatatgactccaaaatgatttaacacatgctgctacaagccagccttcttaagtttttattaaatcttgattgttttggtcacataatttttatattaaatcctgtgatagtcattgtttttctataaaaatcatcacatttcaagtgttaggtagtgtgtatagaactgacaggtaataattttgacaggtatgggattaaatagaatccatccaaaaccatttactttccttatacattatagcagaagtggctaaattagagggttgttcctgtctccatcatgcacttctgtcttctactccatcccttgtatatattggggatattttgagccaagtgctaacgttacttacacagctgatatttcagattaatatgaatgctgaccgtttgccctcacaacatgcccacaacacatggattatacaggggaattaatcgttagcaatgaattcaacatttagcttttaacatttttattctgccagtaaggccagagaataaatctattctttctagcagg

SEQ ID NO: 106596 - DNA, 705 bp, Homo sapiens
acaatcagtaattgaaaaataatgccatttacggcagcatcaaaaatatgaaataacttaagaatagacttaaaatacattcaagacctggtacactgaaaactataaaacattgctgaaagaaattaaggaagacctaagtaaacagggtgattttatcctcatggattagagacttagtattgttaagatcctgaaattgatctatacgttgaacacaatcctaatcaaaaccttaccaggtgatttggtagaaaatgacaagttgattcaatattatacaaaggacctagaatagccaaaagcaattttgacaaagcctaagttggaagactcacactacctgatttcaagatttactataaagctggtgtaatcaagacagtgggataatagtgtatgacagatttatggaccaatggaattgaatagaatcaagaaatagaccagtgcatatatgctcaatgaaatttcaacaagggtgccaaggtaatttaagggggaaaggataatcttttcaacaaatggtactggaacaattaaatagctatatgcacaaattaaaaaaaaaacacccaaaccaattaaataaattgtgactcttcatgccatatacacatattaatgcaaaatggatcatagacataaatataagaactaaaactataaaacttaaaacttaactgtaaaactatagaagaaatc

SEQ ID NO: 106597 - DNA, 423 bp, Homo sapiens
ccctctattctctgatgagctatacctgttgtatatctctctatatctgtctatcctctgataatctatatctattgtatctctctctatatctgtctatcctctgataacctgtatctgttgtatatctctctatatctgtctatcctctgataacttatatctgttatatctctctatatatctgtctatcctctgatattataaatctgttgtatatctattgtctgatggactattttgtatctatcttctgataacctgtatctgttgaatatctcggtatcctctgaggaagtatacctgttatatatttctctccctcagtagattagaaagctgatgcagagaaataaaaatagtagaaacaattatttagaattacatgaatgaagagcttctttttctccccctaatcaccat

SEQ ID NO: 106598 - DNA, 252 bp, Homo sapiens
ctggaggcagaggttgctgttagctgagatcgcgccattgcactccagctctgggcaacaagagtgaaactccatctcaaaaaaaaaaaagttcattcttaagttctattcactcatgctagtttaaaatacagatgaaagcttgaaggtttggtaagctctttcgttttttgtttttttaaaaaaccatggctatggtttgagtgtctcctccaaagctcatgggttggaaagttaatcctcagtgcaaca

SEQ ID NO: 106599 - DNA, 368 bp, Homo sapiens
gaattacaggcaagggccaccacacccggccagatcatcatactgattttttaaaaacaaccccatgaggtggatacaataattaaccccactttccagatgaaaaacaagtacagatagtttaagtaacttgttcgagaatatacagctaataaatgacaaggtcaggattttttttttttttcgcagtctcactctgttgcccaggctgaagtgcagtggcatgatttggctcactgcaacctccgcctcccggggtcaagctattcttgtgcctcagcctcccaagcagctgggattataggcgcctgccacaactcctgactaatttttgtatttttaataaagacagggtttcaccatgttgg

SEQ ID NO: 106600 - DNA, 450 bp, Homo sapiens
ttcacaccccagtgactaagctgaagagatttatcatgatgcctgctcttttctgttggccttggtcacttccatgtgcatgagcatctccatccaaaagtggccttcttctctagccccgatgggatgtcagtagcccatgtttctaatagaagacccatgccaaagccactttgacaactctccagctcgcaggaatgctgtcggcctctagctaaactgttatggtccactcaacgctgtacactgtgtggccactttcctccgcttcctgtacattgtcaggaggttgtaaggcagcaccaggggctgacctctcaggacttgcagcagcagagcccagctgggtacacctgtctaaaaaccacagcacagcagtagcagctcaatggagacattgttctctgcatcccaaagccaggaattcaaaataaagcttggcttccatgc

SEQ ID NO: 106601 - DNA, 541 bp, Homo sapiens
aactgctggatacgatgcatccgccttgcatccacctgtcctcgtttttatttctctctctttcttcttagcaggttggtaaatagatggcctgtgattaactagagccagtatgggttttgagaactagagctactaaaaattagaattagaagtgaatggtttctccatctgttctgtttgcattaaactgtaactatggttttgtgttacaaaagttttaacagaaatgagtggaaccatcctttaaactatgagttatgaaactgaatgattttactataaagatacgtttcaggtatcataaatcgtctgacttattgaatcactatttctggggggagaatgtcccttctcataaggcaaactccccgctgtggaaggcctgccctttcagtgaccctccatgctccctgtgctttcgctgcgggcgttggtgatgacttgttggcccttggtctcactaccctcttggcagttctttgttattttcttccatgattctaaccacaccagctgcttcaatgatcattgtttgtaa

SEQ ID NO: 106602 - DNA, 449 bp, Homo sapiens
agaaagccaatcactggaacttcacttgagcacttaagattattactagaggaagcacaattaaatcatcagtttatcagccatcattataaatcaccaggcaacatatcaagcttcattatttaagaatccttaaccagtgacttcctgcatcactgagagtcaaaagcaatctattcaccaaaaggtacctaaggagtatgttttttttgttgtgtttttattttttttttaccctgagaaatttatcatggaaacataatgaaacccactaaaattaattgtcatgtttttgcatgttttaggcattccgaagtcttcaaaaggaactcagtggtatttgggatatgagtgacgttcctcatcccgatgaggcacgtacatggggatgctgaggctagtccaggtgccaataaaatatggtcagaaccagaccatgtgaacggaag

SEQ ID NO: 106603 - DNA, 548 bp, Homo sapiens
cggccacccatgtattcttgattgaaaacatttgctcatgtcttagttctacagctgaccttctttcactgttttcaaggtcaataactgtgtgttcacacttctgcattttataaatgttactgtgattttcttgtaatgaagaattaaatgttgggagtcaatggcatcagaaccttgcaaaagaggtttttttagcccaggtatgtggaagacacttctttaattttcaataatgggtgtgataaagaccaacccttcccattagcccttccaggcccacatgtaagaattcagacacatcttttcactcatctcagaccttctcagggtaactcggtgaaaatgtcttcactctgagcctcagtgagcctccctgcaacttgcagatgaggggctacaccggaaaagctcaacctgagtgaccctggcccctgaaatgattggcaaaatagagtgggtgtctggatgtggctttttttctgtgagaggggactgtccagttgtaattagaattttaaatgggatgcagtaccctaaaaatgaaa

SEQ ID NO: 106604 - DNA, 610 bp, Homo sapiens
attttttttcttcccgtgtgccaatgcgattttctaaaagaaagaatacgtggattaagtaatgaaggtatcatttcttctgtgtgtaaaatgaacttatgtggctaaaatatttgaagttgaagtataataatagttttagttaaatctttccaataagtattttaaaacatatactaaaaagatacatattctactgaggatgactgcaaatatcagtatgtggatggttaaagggaaaggatctcatatagcgttcttgaatgctgtggccattgaatgtttcaggtcagatttttgtttgccaaaagcattcctattcaatttgtattttttgtaaatgcacttactttaaaaggtacccaattcctgtcttatttactgtttcagcatattaagctctgaaatatagcattttcccaaactttctcgtggttttctattttctcgaagtaaatgacatatttaaccttctttaatattacttgggaaaacttattagaaaacaaaaaatcattttctacttcaaaacgtatctccaaagtgtacactgttaactttgcacttaacaatgttaagttgaacttgtatggatacactttaacttccg

SEQ ID NO: 106605 - DNA, 808 bp, Homo sapiens
gagacagagtctcactctgtcactcaggctggagtgcagtggcatgatctcgctcactgcaacctccatctcctgggtttaagtgattctgctgccttagcctcccaagtagctgggactacaagtgtgtgccacaacacctggctaatttaatacagatgggggtttgccatgttggccaggctggtctcagactcctgacccgcgttggcctcccaaagtgctgggattacaggcatgagccaccgcacccagcctaaattccactttttagtatctttattgatgttccaacttgaattatgtcccttctattgctctgttagagtcactcttattcttttgttgcacttaactataaatttatttttttgtttttaaaagaaatgtttctaacataatagaagttttagagaatgatagaaccagcatctatgtgtccttcacctagctttgtcaaatgttaacatttgtcttatttgtaacagatcttttaatttttttttttttttttttgagatggagtctcactctgtctcccaggctggagtgcagtcacgcgatcttggctcactgcaacctctgtctcccaggttcaagcaattctcttgcctcagcctcccaagtagctgggaccacaggcatgtgccaccacgtccagctaatttttttgtatttttaatagagacagggtttcaccatgttggttaggctggtctcaaactcctgacctcaaatgatccgcccgcctcggcctcccaaagtgctgagattacaggcgtgagccaccctgcccagctagattttt

SEQ ID NO: 106606 - DNA, 413 bp, Homo sapiens
aacctggggcggattctcaggcctggaaagtgctgggagtggctggagttgcccttcctggaggtatctgggatgtgaggaaagaggacgttcttgaccagacaaaagcttcgtccagacagggaggcagggctgggagtgagagagccggtcaggcctggaggcatcctgagcactcacgccttcaggggctagtgctagcaccagggaaaggcatctttgtcctgtttgtgagtctcagcaccttggcagactggcatccatgcctccagcctgaggggccccacgtgggaagcatagagcctgtcctccctgccctaggggctgcaggcctcaacccccaaccaggcaccttctatgcctacagggtcccggggacccaggcccacacctcctgaatgggagagaagcct

SEQ ID NO: 106607 - DNA, 977 bp, Homo sapiens
ctacttctgaaagcagaggtggagacacacaaaagagaagccattgttgctactctcaccaccattgctgtaagccccttcctctgtcctccagatatagaagatctgtgctctgatgactgactgctacttctgaaagcagaggtggagacacacaaaagagaagccattgttgctactctcaccaccattgctgtaagccccttcccctgtggctgaagcagtttctagaagatttaaaaagccaacacatttcccctcttcggttttctctttttccccttttgggagccagatatttaaggactaggacattcaaaagcaactatatataaaagataatttagaaagtaattacacatatttagagaaaggtgccagctgagaaaaggcataagaaaccttaaatttactgatcccaggcacagagacagcctataccaatttaaaaaagaaagaaaagcaaactctgagaaagaaggagaatctgatttccagactttccacattataagattcaaatctccagttttcaacaacagcaacaaaaaaatcacgaggcataaaaagaaacaaaacagtatggcccattcaaagggaaaaactaaatcaacagaaaatgtccctaaggaagaccagatggtggacttatcaaagactttaaaacaacggtcttaaagatgctcaaaaaactaaacaaaaacatggagaaaaatgttttaaatgtatatgaacaaagtggaaatatcaataaagagatataaaacatttttttaaaacctcaaaagtgtttcaaggctaaaaagtgcagtatctgatgaattcgtaggttcagcgatggaagcgggaagatgaactggatgatgagttagtggaacaagaaaaagggggcaatccaggagacgtcttgaaggctgggtatagacgggaaggaagagtgagactggtaacaagaatttatctgtaaaaccacaaca

SEQ ID NO: 106608 - DNA, 322 bp, Homo sapiens
tattcggtgggagtgactttggtgaatagtaagctttgctaaagtgactgtccagtaatccccaggccatcccagatcctctgtttgggcattatttactagtgcctccttaaatggactctgccagtacattcatttgactccctgccttggtttcctaataaagtcagacgctagtcggaggccttggattgtctgcaacccaaagaaccatctccatgatcattagcaggacttacatccgtttccttagaacaccagattcagagcactgttactctgcttttctttttcatatttctttctggttcttgctggataa

SEQ ID NO: 106609 - DNA, 606 bp, Homo sapiens
ggaggcagaagaagagatcactggtctggaggaatcaaagattcaagaaaaagaatggaaggagcaaggaagtaaggatttgggagggttcatgatcaagagtaaaggtgaaggacatgaccttgccagaaggagagacattcatttcatcctggagccaaagattgaaaggcaaaatacaatatacagtctgaaggaattcagaggggaagagaaaggaagtacaaagaaaaacacttcaaatggctccagttttctcagaaaagtagctaactagaagtggagtcttgtgattggggattttaggaacctagaggaagagaaagttttgaaaggccactgaagagaatggaaaagggaattaataaggtaaatgagaggatttttgagtggtaatcaagagacaaatagggatgaaaagttgagagaagaatcaagaaaatgaaaatgatttcaaatgctagcagtactcatagaattttacagaattcctccctcccccacctacacgattttacaaatgaagaatttaattccagagtgggtaagcaacttactgtgagtttgttggagttctaacttctgccctccttctttctgaatgaa

SEQ ID NO: 106610 - DNA, 158 bp, Homo sapiens
cacatgtccttgtgacatgacagctgtcttctcccagagtgaatgattgaagagagggcaaggtgaacaccaaaatatcttttatgtaataaccttggaagtcacacagaatcctagaggttacacagatcagccctattcagcatgggaggggacta

SEQ ID NO: 106611 - DNA, 518 bp, Homo sapiens
ctgactcattccgaatacctgctacctgctccaccctaacttattcttcaccctgcataaccatttttcccaccaagacactcatcccatcactttctttaaattagccaatcagaattagtttagcctggtacagtctaacctagccaataggggaacgacacagcagcaccggcccacgtgcatcagggataagaacccattcccctcccttgtccaagtctgtgctcaccattgctccatctgtaagggcacacccttctatagaagtaacttcccttgctgagaattacaaagaaaattttgtatttgagtgttatttcttttgcagcaccaaagctttattgataacaatttgggggctctcccacgattacattcccctctgggggcgatctcttttcttgttctctcttgtgaggaggtgcaccccacccccttgcagcggcctcaggggtgagaaatcaagacccacccagtgcaaggaataacccaagctctcagcaatgcaaaaataa

SEQ ID NO: 106612 - DNA, 228 bp, Homo sapiens
ttaatactgtgggtttaatggtgtcctggatgtaccaggaagttgacaggatcagagcaagagtcagttggattttccccggttgttcctagtagaggaagaagacctttgcaaagagagaaagtgggtcctggatgggcgtggaggtcgcatattcctctctgggtgcagcttggacaggtcagtcttcttctttgagcaggtgtgtcatcatctatataatgaaca

SEQ ID NO: 106613 - DNA, 177 bp, Homo sapiens
atactgtccataggaaagggaaaagtaaaggatcttaggtcaaagtgagtttgagatatccaaggcaagacatttgcttctggtacttccagtgtggctccatctcagagccatgagagaatgcccctttttaatcctgccactataaggaagtttttccatggaggaacattcctg

SEQ ID NO: 106614 - DNA, 996 bp, Homo sapiens
ctgttatgggacgaatattaaatggcaattagacatagttgtccaatggtgttcagttttatagctggtaacttttttgtctaccagctcagtctattactgagagaggaatgttgaagtctctgatcctaatgttggatttgtcagtttctcctctcagtttcatcagtttttgctgcatgtatttttaaactctgtcgttaggtgcatacatattaagaattctcatgtcttcttaaagaatcaacttaaaaaaaatttttttttgagacagagtttcgctctttttgcccaggctggagtgcaatggcgcgatcttggctcactgcaacctccgcctcccaggtacaagtgattctcctgcctcagcctcccaaatagcttggattacaggcacgcaccatcacgcctggctagttttttttgtatttagtagagacaaggtttcaccatgtaagtcaggctggtcatgaactcctgacttcaggtgatccacccgcctcagcctccaaagtgctgggattataggcgtgagccaccgcagttggctgaatcaactgttttacattatgtaacatcactttttgttcctgtgattttctttgctcttaagtgtactttgtctgctattaacatagccattccagttttcttttgactagtatttgcatagtatgcattttcacatcctttaagtcctagcctcacctcattatatttgaaatggaaagcatttatactcagaagctggagttccttttccctagctcttccctttccagaattgttacctgttgtttcagtgttcctagttgccctgggcttcatcccttgtttctcagtccagaaagatggaaggagttgtattagaattttagcagccactttctgcactgtagctctgacctaccattggaataaagctatttattccttgttggtgcctttccccaaatattgactcccgttccagaatctattttcttttatcccatt

SEQ ID NO: 106615 - DNA, 757 bp, Homo sapiens
aaaaacattagtacaagattactaactggagcccttttcctagatactgttgcttataaattgtaggtatatggtacgttagaagaaggggtcctagtattcttgacctgattatttgagtgatgtgattaaaatttacaagtttttttagctaagggttctagtgatccttcctccttgggagttaagcacttaattgtcctactgttcttccaaagaaatacttaagtgagataccttgaggaggtggtaaggctaagaaagtggattcctgagtaaaatgtcctggattccaatcctcgtattatttgtgaaattttgggtgagtcacttaatctctccaagactaaattttcctatctatgaaatgaatttaattgctgtgcctactccataggattattataagaagtaaatgatgccaggtacagtggctcacacctgtaatcccagcactttgggaggctgaggcaagaggattgattgagcccaggagttcaagactagcctgggaaacatagcgagatccccctctctgcaaaaattaaaataaagtagtaaatgagcctggatgcagtggctcacgcctgtaatcccaacactttggaaggcgaagtgggcggatcacctgaggtcaggagttcgagaccagtttggctaacgtggcgaaaccccatctctactaaaaatacaaaaattaggtgtggtggcgtgcgcatgtagtcccagctactcaggaggctgaggcgggagaatc

SEQ ID NO: 106616 - DNA, 849 bp, Homo sapiens
agcccctctttttaaaaattaatttttctttttttagggttttaaaatttgtttttgttttttcgtttttctttctcttgcctgattgctctggctaggacttcccgcttctctctttaaggacttttgtgattctctggggcctacctaggtattccaggatactcttcccatctcagaaccttgatgtaaccatatctgcatggacccacctagatattccaggacgctctccccatctgagagccttgatgcagtcatgtctgcacggtccccttcgtcgtggcaggtcacagtttcccaggtgtcgcattggtcttccggtctccttaggcaccttttggctgtgacagtctctcatctctccttcattttgatgacagtgacacttttgagaagcactggtcaggtattttgtaggatgaccctctactgggattggtctggtgcttttctcatgattagactggggtgatgggttttgggaggaggaccgcagagagaaagttccagtttcagagcatcttgggtacattccgtcaacatactgtatcactgttgatgtcgaccttgatagcctggatgaggtcatgcctgtgacgtttctgcagtatcaagtttacttttattctccctttggattttattatctttttaacttgacgtgtaagttttaacttcacaggtaataagaacatatcttcctgaggggaagaatatggtttcctgtgactccccgccatccccagccgtacccaccatcatcaatttgctgtgcttccttccaggccttttcctacttatttacattcatatatatgtggccatagagaagatacatattgtcgt

SEQ ID NO: 106617 - DNA, 173 bp, Homo sapiens
catggttactgactacttgtgggagagaaaaaaaaagctaagggcaaagaatcaagtctggtatgttagtttttaccaactgagatgcatccaagatgggattagacatacaaggtaatttatcagggaagacacctgtgagggaatgtggagcaggcatgaaggtagtatgg

SEQ ID NO: 106618 - DNA, 387 bp, Homo sapiens
agggtacagctcctgcagctgctttcatgggctggcgttgagtgcctgctgcttttctaggcgtgtggtacaagccgtagatggatctaccattctggggtctggagggtagtggtcctcttctcacagctccactaggcagtgccccagtggagactctatgtggggctccagtcccacatttcccatccacactgccctagtagaggctctccgtgggggcttcgcccctgcaggaagcttctgtctggacatctggacatttccatatacttggcctccacatccagcatcctctgaattcaagcaattctcctgcctcagcttcctgagtagctgggattacaggcatgcgccaccacagatgtatggatgatatccatacat

SEQ ID NO: 106619 - DNA, 324 bp, Homo sapiens
ggtgaaaccctgtctctactaaaaatacaaaaaattagccaggcgttgtggcgggcatctgtagtccccgctactcgggaggctgaggcacaagagttgcttgaacttgagaggcggaggtttcagtgagccaagatcgtgccactgcactccagcctgggagacagagtgagaccctgtctctaataataataataaataaataaataaataaataaataaataaataaaaagaaagaagggggaaagtggtccccatgagtgattccagcaaggaggatgcagaccctgtgctccaggcatcatcagagttgggagcaggct

SEQ ID NO: 106620 - DNA, 292 bp, Homo sapiens
cagggtaagcagatcgtggggaagaaagagggtttctccaccatccattctgctgaggctgcttcaattttctctctacacagccctaatctcttagacccagaacttttaaattcctagaagaagaggggcctaaatatatcttacatacttttcctttcccctcttcatttaaattgactaaaattaaatgttcaacatcttcatcttatgtttcatgtagtgaactgcttaatgttatctgtcttgatttggcttttgtttttttccccttagaattgctacaaactag

SEQ ID NO: 106621 - DNA, 635 bp, Homo sapiens
tgacccaaacacaaccaactccttttatttccccacttttttgaatatactctttcctccgcctggaaatcctcagctcctcttctcttggctgggaaatgactaagctttgagacccaagtcaaataccaccaccttcgggaagtcttcccagactcccccaaggcagaactagctatcacctccccccaggcagaactagctatcaccgctttgcaagtacatgaacatccattatgaggctgtctccctccccagaccaacagtccctcaggttcagtgggtttatttatcttaatcacgccagtgcctcaggaagttttgtttttgttttgaaacaggttctcacactgccaaccaggctgggctacagtggctcaatcacagctcaccgcagccttgacctttgggtgacagagcaagactctatctcaaaacaaacaaacaaacaaaaaaaccaaagaggcaacacattctgcttctatggcaacggggagacaggcactcaacacgactgcaaaacgggatggccctgaagacaaacatttggcaaaatccagagcagttattcatgcatttactcttctgatctagcaagcccactcctaggaatctatcccaaaagacactttggc

SEQ ID NO: 106622 - DNA, 389 bp, Homo sapiens
tatatacattgtggatataactaaaattaacatatgcgttatctatcttatgtagtcattgtttttgtggtgaaaacattttacatctactttcttagcatttttcaagaatgtaatatattaagtatagtcacaatgttgtacaataatctctagcaattctaagttagtagttacccagttgaaagagcaataaatgtactttgagctcagaggtgcctactgtgaatcaaaaatagagaaagtagatggaaaaacaaattgtataagtattctttgtgctttcagacagagttaccaatttcccttttcttatccaaaaatgccatttatgaatttctataaatgatctgtgtgtagctgtttgactgtaagggataagtcagctg

SEQ ID NO: 106623 - DNA, 377 bp, Homo sapiens
tgagacagagtctcaatctgtcacccaggctggagtgcagtggctcaatctcagctcactggaacctccacctcccggatttaagggattctcctgcttcagcctcccaagtagctaagactataggcatgcaccaccacactcggctaatttctgtatttttagtagagatggggtttcaccatgctggccaggctggtcttgaactcctgacctcaagtgacccacctgcctccgcctcctaacgtgctggaattacaggtgtgagccaccgcatctggccttttcatttacttctacttacctatcctcttcggtaaattcttaaaatctattatgattataaatataccttacattaatgtttcatttagtat

SEQ ID NO: 106624 - DNA, 520 bp, Homo sapiens
tggctgcttaacaaagtttgagtcctcgaacttctcttgctattctccattcactccttaggttatcttattcagtactacagctttaaatatcatctataaatgaatgactcccaaacctagattcatatcgcagacctttctgctaaacgctagactcagataccaactgcctactcaacagccctgcttaggtgtctaacaggcctctcaaacataaatgtctaaaatggaatgccttatcttctccacaaatctacttcttttccagtcttctacaactcggtaagtggtgcctgtgcttttttagatacaggagccctaatacctgatcattatccatgactttctcacacccacattcaatccattagaaaatccttgtggctttctgacacgattttgctgtgtccccaaccaaatctcatcttgaattgtatctcctttaattcccatgtattgtgagagggacctggtgggagataactgagccatgggggcggttttccccatgctgctc

SEQ ID NO: 106625 - DNA, 375 bp, Homo sapiens
ttattatatacagtattctttcaataaagtaagctagagaaaaagttactaagaaaattataaggaagagaaaatatatttactattcattaagtggaggtggatcatcaaaaagattatcatcctcatcatcttcatattgagtaagctaaaaaggaagaggaagaggaggagttggtcttgctgtcttaggggtggcagaagcaggagaaaatttacatatatgtggaccctctcagttcaaacttgtgttattcaagggttaactgtatatcatggaagatgttaataataggggtagctgggtgtaaagtatgtagttattctgtattgttttcacaattttgctgtaaatctaaaaatgctctaaaactt

SEQ ID NO: 106626 - DNA, 325 bp, Homo sapiens
gttttgccatgttgcccaggctggtctggaactcctgagctcgagagatctgcctgccttggcctcccaaagtgctgagatttcaggtgtgagccaccgtacccggccaacacaagtgttttaagcacaccatcccggaggtccgaaatcccaagcctgaagtgccggcagggctggctccttctggagtcccagggaggggtccatttccttgcctcttccagcttccggtgaccaccaccctccccggctgggcccctcctcccatcgctccagtccttgcttcccctgctcatctccttctccagcgactctgaacctctgc

SEQ ID NO: 106627 - DNA, 899 bp, Homo sapiens
agccgccaacagacacttcctgtacaggggaggggggagggggccaggcagccgttagacagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaacaatgaatcctccaatgtacctgactctccctttgcgaagagcatctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaacgagctatcagcttcccagtttgcacaattcatcaagaaattatgcggggtcactggcacaaatgatgaggcatctcctggaagcttaacttcttatccatcccatctcttggacagatgatgccagttaattaatttgaatgggtctgtcacacgcagcccaactcaactggagtcctgagaaggtgaacagaccaggatggatggccagggaactcaccagaagtccccaggcatcagaacaaggtcgaagcatcctggtgagcagataacacg

SEQ ID NO: 106628 - DNA, 973 bp, Homo sapiens
tccgaggctgggggagcagccgttggctctggtgcccctgggggtgggagcacgagtgggcaaggatgatggtgaggcagaggaggcggccccgagggagcgcccggctgagaggcggggggccgaggggcccggggagcgggcgtcaccgagggccctggaagcggcagggctgggggagaggagacgcgtgtctggagcatggggaccccagcccagctcccacttgcagacctgggccgcgggctgccggccgagtggccggggggcctggctgcccaggaggcgggccggggccggggccgcggccgggggcgcggagcggagttagggtcgccaggccgagccgaggtgggacggaccgacgcagagaggaagggaagccacctggcctgaagatcctgtctctaagatcccattctgaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaagtcagtaagaccaagaacccaccaattccggacacagtagcatttgggaataataagaattgtagctgggcatggtggtacacgcctgtagacccctagcagctgccatcatcctcaccatccgcatattattgatatattaactctttgatggcaaccatggcttatcccccctatctccctatgccctacagcagggcagtggaatggttaagaggctttgaagtctaagagtgctggcttaaaaccctaat

SEQ ID NO: 106629 - DNA, 514 bp, Homo sapiens
caagtgcttaacaaagctttcttggtccttccatggtgttggtcagtcaaaatgaattggggtctcctgctgggtttgggaagattctgtctcattggtaggctctgaagttatggtaacctccacatctgcaggtttaactgtaatgttgggcaagtgataataagcttgatcctcacctggaggttgaactgacacctcatgattcggtagagttagactctccatagaggactctggaggcagagctggggcctcctgctgcattgaagaaggttcttcctcaaggagctgtggaagctgtgctggggcttcttgttggagtgaagaggactggatgtcttcaagggtctctggattttgagtttcgggctctagatggaattgagaaggtccaacttgctcagagggccctggaggctcatctgacttcacccggagttctggaggcaggctaccgggatacggtgtatctgtactggaatattcattctgcaaattctgtttctgacta

SEQ ID NO: 106630 - DNA, 840 bp, Homo sapiens
tccgaggctgggggagcagccgttggctctggtgcccctgggggtgggagcacgagtgggcaaggatgatggtgaggcagaggaggcggccccgagggagcgcccggctgagaggcggggggccgaggggcccggggagcgggcgtcaccgagggccctggaagcggcagggctgggggagaggagacgcgtgtctggagcatggggaccccagcccagctcccacttgcagacctgggccgcgggctgccggccgagtggccggggggcctggctgcccaggaggcgggccggggccggggccgcggccgggggcgcggagcggagttagggtcgccaggccgagccgaggtgggacggaccgacgcagagaggaagggaagccacctggcctgaagatcctgtctctaagatcccattctgaggcttcgagggtctggcttgagcagcacagacagggacgtgtctaaccgggatgaccatgaggtctcatcgcagtttgccactaaccagatggagtctcgctctgtcaaccagactgaagtgcaatggcatggtatcgcctcactgtaacctctgccttctgggttcaagcaattctcctgcctcagcctcctgagtagctgggactacaggcacacgccaccacgcttggctaacttttgtatttttagtagagatggggtttcaccatattggccaggatggtctcaatctcctgacatcgtgatccacccaccttggcctccgaaagtgctgggattgtaggcatgagccaccacacctggccttcaagtgctatttctttgcagtaccaggggacaagcattctctttctaa

SEQ ID NO: 106631 - DNA, 724 bp, Homo sapiens
tccgaggctgggggagcagccgttggctctggtgcccctgggggtgggagcacgagtgggcaaggatgatggtgaggcagaggaggcggccccgagggagcgcccggctgagaggcggggggccgaggggcccggggagcgggcgtcaccgagggccctggaagcggcagggctgggggagaggagacgcgtgtctggagcatggggaccccagcccagctcccacttgcagacctgggccgcgggctgccggccgagtggccggggggcctggctgcccaggaggcgggccggggccggggccgcggccgggggcgcggagcggagttagggtcgccaggccgagccgaggtgggacggaccgacgcagagaggaagggaagccacctggcctgaagatcctgtctctaagatcccattctgaggcttcgagggtctggcttgagcagcacagacagggacgtgtctaaccgggatgaccatgaggtctcatcgcagtttgccactaaccaggaccctaggagtgctgttttattgtctccacctgacagataaggaaatggcagctgacccaggtcaaggaagttcctgaggtcccagggctaataagtggcctgactccaccaccagcccccaggaggaagccaaccccagccctagaaaaacccaattcctgagtgagtgctgtaaaccaaaaataaaattctaagcttcccaactgcct

SEQ ID NO: 106632 - DNA, 686 bp, Homo sapiens
tccgaggctgggggagcagccgttggctctggtgcccctgggggtgggagcacgagtgggcaaggatgatggtgaggcagaggaggcggccccgagggagcgcccggctgagaggcggggggccgaggggcccggggagcgggcgtcaccgagggccctggaagcggcagggctgggggagaggagacgcgtgtctggagcatggggaccccagcccagctcccacttgcagacctgggccgcgggctgccggccgagtggccggggggcctggctgcccaggaggcgggccggggccggggccgcggccgggggcgcggagcggagttagggtcgccaggccgagccgaggtgggacggaccgacgcagagaggaagggaagccacctggcctgaagatcctgtctctaagatcccattctgaggcttcgagggtctggcttgagcagcacagacagggacgtgtctaaccgggatgaccatgaggtctcatcgcagtttgccactaaccagataaggaaatggcagctgacccaggtcaaggaagttcctgaggtcccagggctaataagtggcctgactccaccaccagcccccaggaggaagccaaccccagccctagaaaaacccaattcctgagtgagtgctgtaaaccaaaaataaaattctaagcttcccaactgcct

SEQ ID NO: 106633 - DNA, 1439 bp, Homo sapiens
agccgccaacagacacttcctgtacaggggaggggggagggggccaggcagccgttagacagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaacaatgaatcctccaatgtacctgactctccctttgcgaagagcatctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaacgagctatcagcttcccagtttgcacaattcatcaagaaattatgcggggtcactggcacaaatgatgaggcatctcctggaagcttaacttcttatccatcccatctcttggacagatgatgccagttaattaatttgaatgtggcctagggatttctgggaggatccgaagaacaaggctgtctgcagtaggagcctcctgttcctcgccacctaagcttcagccctgcccaactaacagctctccatgttctaaagaaggtgggagtgctggaccaccccagccttctggaaccccagttctgtgacattatccatctcctggaaatatgctggttttaaccatgcaaactggccaagcatcaggcagaaatagcagctgtgcctggaaggacaggtgacatctgtgaagaaaatggccaagcaggacagggtggagagcacgggctgttcccttcctttctgggaacagcaccacctttgggggaactccttctctcatggggttttaggcaggggctgccagtcccagggccctgcctcctgtcaccccccatatgcataggaacacttgtgcaccagtcgctacatttgcaagtggaagctggtggagctgctcagctcccaacaggaagcccatgtgtgcggggccagaggacacagcccatctgaggcgctaagcttctgtgaagagggagtggagtctggatgggattccaatcccacggtccaccccttctgggacccagactcacccttccccttccttcaattctgagaaacaataaatgtccctacttgcgaacaaaaaaaag

SEQ ID NO: 106634 - DNA, 1517 bp, Homo sapiens
agccgccaacagacacttcctgtacaggggaggggggagggggccaggcagccgttagacagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaacaatgaatcctccaatgtacctgactctccctttgcgaagagcatctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaacgagctatcagcttcccagtttgcacaattcatcaagaaattatgcggggtcactggcacaaatgatgaggcatctcctggaagcttaacttcttatccatcccatctcttggacagatgatgccagttaattaatttgaatgctctgctgctatggtgagctgcacgtctggaggcttcacagagacactgggtgaatctaaatgatgagtttgatggtgacctggaggtgaaactgtgacttcatgatgttctagaggctgacctggggtctcctgctgggtcagagaagatttgacctccccagaagactcagaaggctgaactggctgctgctgctcactgatggaaagttcatgctccataggaggaactggaggctcaattggggcctcctgttgggttgcagaaggttccacctcctctggaaactgaattggggtctcctgctgggtttgggaagattctgtctcattggtaggctctgaagttatggtaacctccacatctgcaggtttaactgtaatgttgggcaagtgataataagcttgatcctcacctggaggttgaactgacacctcatgattcggtagagttagactctccatagaggactctggaggcagagctggggcctcctgctgcattgaagaaggttcttcctcaaggagctgtggaagctgtgctggggcttcttgttggagtgaagaggactggatgtcttcaagggtctctggattttgagtttcgggctctagatggaattgagaaggtccaacttgctcagagggccctggaggctcatctgacttcacccggagttctggaggcaggctaccgggatacggtgtatctgtactggaatattcattctgcaaattctgtttctgacta

SEQ ID NO: 106635 - DNA, 1312 bp, Homo sapiens
taagaataacaatgccaaggttttcattcttgaaaggagcaattaagcgtctcaccccctcctcattttagatgggaactgtgagggtcccgtcatttacccagggtccctgttgaggatcttgtcctcattagatgacttcttgtgcagcttccatgcgtgattctttactcttgtggcactgagaggtttgtacatgtctttaagccagagcggctttctgaatgaaaaaagtccatcctagaagatagaaagggaaatattaattttgcatgtcctctgctttccctggtcacagcaatgaatcctccaatgtacctgactctccctttgcgaagagcatctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaacgagctatcagcttcccagtttgcacaattcatcaagaaattatgcggggtcactggcacaaatgatgaggcatctcctggaagcttaacttcttatccatcccatctcttggacagatgatgccagttaattaatttgaatgtggcctagggatttctgggaggatccgaagaacaaggctgtctgcagtaggagcctcctgttcctcgccacctaagcttcagccctgcccaactaacagctctccatgttctaaagaaggtgggagtgctggaccaccccagccttctggaaccccagttctgtgacattatccatctcctggaaatatgctggttttaaccatgcaaactggccaagcatcaggcagaaatagcagctgtgcctggaaggacaggtgacatctgtgaagaaaatggccaagcaggacagggtggagagcacgggctgttcccttcctttctgggaacagcaccacctttgggggaactccttctctcatggggttttaggcaggggctgccagtcccagggccctgcctcctgtcaccccccatatgcataggaacacttgtgcaccagtcgctacatttgcaagtggaagctggtggagctgctcagctcccaacaggaagcccatgtgtgcggggccagaggacacagcccatctgaggcgctaagcttctgtgaagagggagtggagtctggatgggattccaatcccacggtccaccccttctgggacccagactcacccttccccttccttcaattctgagaaacaataaatgtccctacttgcgaacaaaaaaaag

SEQ ID NO: 106636 - DNA, 1421 bp, Homo sapiens
agccgccaacagacacttcctgtacaggggaggggggagggggccaggcagccgttagacagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaagttcgtgagccacacatctccccacaccaagctcctccatacaagacctcggactgcatcacgtaaatgctttttcaggggcaaaatctagagaatctgaaacgagctatcagcttcccagtttgcacaattcatcaagaaattatgcggggtcactggcacaaatgatgaggcatctcctggaagcttaacttcttatccatcccatctcttggacagatgatgccagttaattaatttgaatgctctgctgctatggtgagctgcacgtctggaggcttcacagagacactgggtgaatctaaatgatgagtttgatggtgacctggaggtgaaactgtgacttcatgatgttctagaggctgacctggggtctcctgctgggtcagagaagatttgacctccccagaagactcagaaggctgaactggctgctgctgctcactgatggaaagttcatgctccataggaggaactggaggctcaattggggcctcctgttgggttgcagaaggttccacctcctctggaaactgaattggggtctcctgctgggtttgggaagattctgtctcattggtaggctctgaagttatggtaacctccacatctgcaggtttaactgtaatgttgggcaagtgataataagcttgatcctcacctggaggttgaactgacacctcatgattcggtagagttagactctccatagaggactctggaggcagagctggggcctcctgctgcattgaagaaggttcttcctcaaggagctgtggaagctgtgctggggcttcttgttggagtgaagaggactggatgtcttcaagggtctctggattttgagtttcgggctctagatggaattgagaaggtccaacttgctcagagggccctggaggctcatctgacttcacccggagttctggaggcaggctaccgggatacggtgtatctgtactggaatattcattctgcaaattctgtttctgacta

SEQ ID NO: 106637 - DNA, 979 bp, Homo sapiens
agccgccaacagacacttcctgtacaggggaggggggagggggccaggcagccgttagacagcacaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgcaccaccttaagagctgtaacactcaccgcgaggttccgcggcttcattcttgaacaatgaatcctccaatgtacctgactctccctttgcgaagagcatctccgtggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaacgagctatcagcttcccagtttgcacaattcatcaagaaattatgcggggtcactggcacaaatgatgaggcatctcctggaagcttaacttcttatccatcccatctcttggacagatgatgccagttaattaatttgaatagaagactcactggtggcacctgcagctgcggcgttttccccaagctggtctgtggagaagcctgggacagaaagaagcagccagactccagaatcccccattttaatagctattctatgctatgtccccgtcttattcctggcaacttacctctcagctcgtgcactgtgacattacagcaagaagtactaatataaatgacacaaaagaaaa

SEQ ID NO: 106638 - DNA, 401 bp, Homo sapiens
ttttattttgatttttgaaaacttaattaaattttatgaaattaaaattcataattctagcattcaatgaccacctcattgccaatgcaaagaataagcatcactgtttgtctgagggctagacatagatacaaatttaagagtaatgtgtaatgtgatttatttaatccttttctcatttgcccagagaagactcactggtggcacctgcagctgcggcgttttccccaagctggtctgtggagaagcctgggacagaaagaagcagccagactccagaatcccccattttaatagctattctatgctatgtccccgtcttattcctggcaacttacctctcagctcgtgcactgtgacattacagcaagaagtactaatataaatgacacaaaagaaaa

SEQ ID NO: 106639 - DNA, 81 bp, Homo sapiens
gatcctgaggctttgatgctattttcttaatccagctggtctgtggagaagcctgggacagaaagaagcagccagactcca

SEQ ID NO: 106640 - DNA, 440 bp, Homo sapiens
ctccagcacagggttaataccaacgagtttccacctccagctgctcctagagtggccacagcatgagccatctggtgggggacctagccgccaacagacacttcctgtacaggggaggggggagggggccaggcagccgttagacagcacaaccgaacccaacaccggggcccaacggcaggggcttgggcaggagcaaggtccgagggctgccaggtaagtcacagggccactcatccctaaggccacaacgcaagggagcaataaaggccacagggaggccaagaccttaaggggagccaggccgccgcgtcccctaggcagcgctcagcggggaaggagttggaggtgtcactatggggcctcaagccccaagatgtacaaagttctaagaaaaaaccccaaagtttccttcaaaagcaacataagaaaaagttaaa

SEQ ID NO: 106641 - DNA, 252 bp, Homo sapiens
ctggtgaaggggtacagagtactacaggacaccagcgtgaagattaaagggaaagtgtttcagactagaatactccctgtctttttctgtataaaatagaaaacattttgctaacattagtaggattatagttacttttcgtatcgttctcttcgaacctgcctaacattgcagagcaagtagggtgagttggaaagatttttcaggttctcatattgactattttgcttttcatttttattcctttctcct

SEQ ID NO: 106642 - DNA, 715 bp, Homo sapiens
ctgtgccagcgtgccccctgctggtgactggggcaactgcagggttctcttgcttccattagtggccagcggcccctgctggcggcggggcaccgcagggtcctcttgcacacagtatagtggcggcatgccgcctgctggcagctggagacattgcagggctctcttgctcatagtatagtgacaggacgcccgcctgctggcagctggggacactgccggccactcttgctccaagtgtagtggctgttggctcccctgctggcagctggggacactgccgggccctcttgcttgcagtttactgggggcacgcccccttctggccgcttggggcactacaggatgctcttgctcacagtgtagtggcagctcgccgcctgctggcaaccagggtactgcagggttctcttgctcatggtgtggtgcccgtccaccacctgctggcagctaaggacactgcagggccctcttgctcagagtgtagtcgtcgtacaccccctgctggcagctggggacgctgccgggacttttcctggcactgtcgtggcagcacactacctgcaggcagatggggactatgcagggacctcttgttcagggtgtgagggctggcacgccctactggccgcctcctgcaccacttaaagtcggagcgccagttaagcaccatcagttctggaaattgaaactgaaatggagctattactgagga

SEQ ID NO: 106643 - DNA, 513 bp, Homo sapiens
acgtcactcacactaatgttatctgtgtggatgccaccaggaccacagatgagattgtagagtgtaagtcagcattgacactaataatgttcttatataaactatctggtctataaggcagttggtgtgacattttcagacattagagaatagataaatgtgtattacagctttcactggcatggtgggactttcccgcaatggatagaacacacattgtagtagtcagtggtccagaaagctacccctgttttgatatctttgtagtattgagggcagtgatgtcaaacagtgaataaagttatatatctatgtggtgatcttattttaacctcaatattattttagtgatttgtaagtcagaatatttgaaatcaaccttgctagaaaatccaggaagcatggtcctcaaaaatatatatatggcactgagtctcagttcaaagatttggcagtttgattggggaggggttgtatccttgaaatacagtgttgtttctagtgactagaaat

SEQ ID NO: 106644 - DNA, 378 bp, Homo sapiens
cttaaaagaaagagaaataataatccaatgacggaaataaaatggaattataaaaaatattcaattaactcaaagggaaaagagcaaaaacggagcaaagaatagatgggacaaatagaagctggtagtaagatggcaaatttaaactaaggaacgcagttcaaagccagaaattgtaagattggattaaaaaaagcaagtctcaactataagctatattcaagaaactatatatacacacatatatatatgaaaccatgtatatacatatatatgtatatatgatttattgagtgatactgataggttaaaagtggtggaaaaagaaataccacacaaacacttattaaaagaaagctagaatggctatattcatgt

SEQ ID NO: 106645 - DNA, 108 bp, Homo sapiens
tggggtctggcatacgtggagttctgtaattatgtccaagaagaggtgacatcagaatgttctttcttctgtaactacaaatacctcatgagagaagatgtttttaaa

SEQ ID NO: 106646 - DNA, 752 bp, Homo sapiens
gaagagtttaaagggaaagacacattagttgtgtagcagatgggtctgagattgattgaccgattgagatagggtcttgctctgtcacccaggctgcagtgcagtggtgccatccctttaaactcttcggtacttcctgatatagtccaaactctttgacataacgttttagtctcaatctggcttcagccttcctctctttacattccctgtctcctactttgctgttcagcaacatcaaaccctgtgtgcttttccatagactgtactatttctactatatctggaatttcacccccattcacctactcacccaaacaaaacaactggtcaatttttactcatccttcacctcagttgtcaccactctcagggagctcccttaaataagatatgcctccttggtgttatcataataccctctgcatatttttaccttgtggtattttaattatctgtttatatatctaattcttccaccatgctctgaattttttgagtatatggtatatacttagtacgatgcttgctatataacaggaacacagtgaatatttgaatgaatgaataatcttggctaccaatttgctgtgtttccttgtccctttctgcatatgtggctttgtcttttaagttctttataaaagatgaattgagataaattgctaaagctccttctaattctgaaataacttaattcttttttttttttcttcgagacggagtctcgctctgtcgcccagactggagtg

SEQ ID NO: 106647 - DNA, 877 bp, Homo sapiens
actcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagtggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcataaaaaaaa

SEQ ID NO: 106648 - DNA, 531 bp, Homo sapiens
ttccccctgcacagatctccccggcccacaaaatacttaaaaagtaaccggactctttgttcagggctcaatctttttggatgttaatctgactgggccggtgcacctaaataataaataatatatatcctcctcgacctttggtctctctgattcctaaattatcctgctgcaccaggacttataggagcagaaatcagaagactttactccacacacttcaggtggacatgtggacaaagccatcggagaacatgacaaaaatacagcaagagcagagacaagatcagatcatcctgggggcagatgctgggctctgaccaatttgagagagaaaaggaaaaagaacccagctacaagatgcacaagtagcagccacagccaccaacatcagcagagcaattggaggccaggaagacaaggacacttctgaagagactgaaaaaagcagaagacagtccaagtcactgcaaggttccaagatggggtttctgagaaagaccaaattagttatagagcactagctcccaa

SEQ ID NO: 106649 - DNA, 407 bp, Homo sapiens
tacatcctgataaatgtgtcataagttgaaagtatcttataagtcgaaaatgcatttactacagcctaaccccactgaacattgtagcttaggctagcctaccttaaaacgtgatcaggacacttccctcagcctacatttgggcaaaatcacctaacacgaagcctattttataatagagcattgaatagctcaaataatttattgaatactgtacattacatagaatttgtgacagttttacaccatcattatgtcaaaaaatcattaagttgagccaccataactcagggactgtctgtatttatatttttacttcacactaagctttgaaactgaaatttttgctcctcagcagatggggtttctgagaaagaccaaattagttatagagcactagctcccaa

SEQ ID NO: 106650 - DNA, 324 bp, Homo sapiens
cagcagagggagacagattcgggcttgggactcctgtctctttgggagtgaactttcaacataaagcttgtctcaaaaacaaaaatccagtgacaactcaatgtattggctcttagcacattggatagtaagcactgttttctcaataacaagaagacctgaaaaaaacccagagttctgctttccaaataaggtttagtgaagctaagtggacatattttcattgcttaattcttccagcagtcaagaaaaacttgatcactttgccatttgaggcctttgacaaaaagagcctgcacctaaagatattctttggggtgtctg

SEQ ID NO: 106651 - DNA, 260 bp, Homo sapiens
gaacatgttaaatatacaatatatatttctttattttgcccttattccacagcttagttttttagtgactgggtatattcatgtgtgtgtatagtgtgagtgcatgtgtgtgcaattgagtgaagtgggaaagtagtgcttctatagtttgatcagggctttacacaaaaaagccacagagattttcccttaaatttgggaaaagacaaagatacccccatgattgccactgtttaatacagtactgaaggaccttttct

SEQ ID NO: 106652 - DNA, 816 bp, Homo sapiens
tcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaataaaatagaatcatgctttgggaggccaaggcgggccgatcacgaggtcaggagatcgagaccatcctggctaacacggtgaaaccccgtctctacta

SEQ ID NO: 106653 - DNA, 809 bp, Homo sapiens
  misc_feature (787)..(787): n is a, c, g, or t
  misc_feature (809)..(809): n is a, c, g, or t
tcccgagtagctgggactacaggcgcctgccaccacgcccggctaatttttttgtatttttagtagagatggagtttcacagtgttagccaggatggcctcgatctcctgacctcgtgatccacccgcctcggcctcccaaagtgctgggattacaggcgtgagccaccgtgccccgcgtgtttttttctttagctgattgacaggtccccttcaaagttacaaaaaaaagtgctaatttttgctgttaaattctggttgttatttaattgacagaagtctcttgatgcacgaataaatatctctacatctagcctttgttaaaaataaaaattaatattctacaaacacctacatatactagagaggggtgaaacactgcagctaattcctttataatactttcagatgattgcattaagcctttcatgttatgtggcattgttaatttttcctagatacccatccacttaagggccagagaaatccttattcatttaactctggtgggcatttatgtaacatacccaaataaaaacgttattaaacagccacaatcgcattcagtcaacttggcactgaatgtagcttctaaaatcagttctctaccctacgaatggaatgttctaccaagaaagagaagcatcaccatgtcatcttgtgttctacaccactatagagagttacagttgcccccaaacacgaatgctattcccaaagtgctgggattacaggcgtgagccaccgtgccccgcgtgtttttttctttagctgattgacagtccccntcaaagttacaaaaaaaagcgn

SEQ ID NO: 106654 - DNA, 622 bp, Homo sapiens
tgatggattgcttgtgacttttaagagaaaggcgtcaaggttgcttaaattgttaacagtttagtatgctaaaaatacttcttgctactttctttccctgaaaagagataacaacaaaaaacctgataatatgaagtgctgactagaatacagagcaattagaattctcatacattgctggtagaaatataaaatggtacagctgctttgaaaaatagtttgacaatttcttgcaacatgattcagcaatccccttcctagatatttacctaagagaaaggaaaacatatgtccacacaaaaactttaggcaactctttatagtggctttattcataatagctccaaactggaaacaacccaagtgtctttcagctggtaaatggaaaaacagactgtaatacatccacagagtggaatattactcagcaataaaacaagctactgttacatgtaacaacatgggtgaatatcagatacttcatgttaaatgaaggaggtgactcaaagggttaccagctgtgtgattccacttatatgacattctggaaaaggcagaatacatacatggaaaaagcaaaatacaattttccatcctatgggatggaacatcagcatcactg

SEQ ID NO: 106655 - DNA, 191 bp, Homo sapiens
tgtcttctagaatgttacaaattgaatgtgaaattttaaaaatggctctctctaatacaaatgaaaactttataaataattccattttattccttcaaaacagacacaataatacactgtcaagttaggtggtccaccctgccaaattttcaactgctattcaaagtttcttctgtaacaaaaagataaac

SEQ ID NO: 106656 - DNA, 405 bp, Homo sapiens
tgctgggataattggcaagccacatgtaaaagaataaaactgaatcctcatctctcaccttatacagaaatcaacataagatggatcaaagacttaaatctaaggtctgaaaccataaacattctagaagataacattggaaaacgcttctacacattggcttaggcaaacagttcatgaccaagaacccaaaagtaaatgcaacagaaacaaagataaatagatgggactcaattaaactaaaagcctcctgcacagcataggaaataatcagcagagtgaacagatcacccacagagtgggagaaaattttcgcaaactgcatctgacaaaggactaatgtccagaatctacagggaactctaatcagcaagaaaaaataatcccatcaaaaagtgtgccaag

SEQ ID NO: 106657 - DNA, 384 bp, Homo sapiens
ttggcctcccaaagtgctgggattataggcgtgggccaccgcacctggtctcactacgttacattcttaatatggttttgttagcactctctgtgccaaaatcctattttcccctcttttcccttaggcagggcatgcacagagcagatctatttcctaccaaccttttttcccatggcacacacagctgccccttggcaataagatgcagtccctgactaatgcagcattgctctctgaagattttaatccagctttcttagtctcacctagctttatgaaaaatgagaggctagatattttgctgtttcttactaagatttgcattgctcatactataggtgccctgtgtaattgctctaacattttctcttcacacaagat

SEQ ID NO: 106658 - DNA, 832 bp, Homo sapiens
gctgaagtcaaggtgttggctgacacacagtcctctcggtcctcagtccagtgtgggtttccctgggctgaagtcaaggtgttggctgacacacagtcctctcggtcctcagtccagtgtgggtttccctgggctgaagtcaaggtgttggctgacacgcagtcctctcggtcctcagtccagtgtgggtttccctgggctgaagtcaaggtgttggctgacacgcagtcctctcggtcctcagtccagtgtgggtttccctgagctgaagtcaaggtgttggctgacacacagtcctctcggtcctcagtccagtgtgggtttccctgggctgaagtcaaggtgttggccagggctttgctttttgcaggccctacaggaagatgttctcttgctcgttgggaggttggcagaattccgttcttgctggtggtaggactggcagtagcaccttgctgggtgcaagccgagcctttcccggcttctccaggccgcctgcgttgttcacggagggcccttgcccatctgcagagccagcactggcgggtgaagtccctctcatgctttgactctccttctgtctcatctgtagctcagccaggaaaggcggttaaggacttatgtagttaattggccccacccagataatcccggataatctcccacctcgagatccgtgcaccttaatcctgtctgcagagtcccatgctagcaactcagcagcaaacagcccctgcactgtgccctgcaggaacatggctgctggtggcaggccggcccagacagacagactaccacctgagccaaggaacctccactcaggtggccgagg

SEQ ID NO: 106659 - DNA, 386 bp, Homo sapiens
ggggctttcttttttaggaataaatagtttatttacaaatcattctgatttcttattgaagttagtggaaaattgaacacttattcatgctacaaaattaccagtgatagttactaccattatatgtcctagtctccaaatacctagtacttacctgtaatcaagaaatgatttgaagagctaagtatgttatagttcccaggatgctgcttatggttttctggctgctctttaactttaatgaatattcaatggcttattattattccaaatgagagagaacaacattgatttctttattgtaatgttctcaaggtcaatctacattataaatgagtaggcaggctggatacttgggaaaatttgaagatgccacatgtccccat

SEQ ID NO: 106660 - DNA, 236 bp, Homo sapiens
  misc_feature (35)..(36): n is a, c, g, or t
gattatagccttaccctcggagccttagtttcggnngccttaacctagagtcattggctcaactcagtcactatgagacacctggaaaactgccccaccttgtggctccactgcctgatgactgaactgacctccaggcctgactctggtctcccctgtgttatttctgctgaagtacccagttccaggccaggctttctaatacccaaagggcttaaggacaatgggaagttcca

SEQ ID NO: 106661 - DNA, 80 bp, Homo sapiens
ccttttaatccgttttgaggctggagaatggcgtgctcttcgtctgccctcattctgggaaactggaggacacttctaag

SEQ ID NO: 106662 - DNA, 384 bp, Homo sapiens
tggtgacagctgctcccccttcacctgagttggggttgggggaaagggagggcgagcccttgggataccgtttgatgccctgtccaatgtgaggactgcctgggcagggtctgcccctccaacccctctctgccctggaagccctacactccacttggagtctggatggacgcatgggcctgggaccctgaagcagcctcactctaacttcgtgttcacactccatgtgtgaatggagttcaggctgggagacaggcagaggcctaggagaactaaaacagtgtttgtggtggagcggcaggacccgccagagccacagatatatggtgatccaggaggctcaaagagaagccaagtcagctttgttgtgatttgatttttttt

SEQ ID NO: 106663 - DNA, 552 bp, Homo sapiens
ctgagttatccagaaaggctggaaatgaagtgttgtagataaccagcttactttttaaggataaggttttaatttattgaaaccatctgagaatgttattcttcttagttcataagggtagcatgctctatacatagcacaagaaagagcaccaaattggccattaagcccaaacaacaaattgggccaacatctaattataacttattggccaacaaacccaaactgggataactagcctgtaattacagaggataaaaatcaatctctaacctatagaggaatttggcaacacctagcaacacattctaaaatggtcatgaaattcaaagactagtacatattacatgagacaaaaaagacatgacaaccaaatcacttaatcctatatagaattattttcttataaaggacattaaagcaattggcaaaatctggataagtctgattaggtaacagtactgtatcaatatataatttcctaatttggataactataaactgtggttacataaaagaatgctctcattttcagaaaatacagactaagca

SEQ ID NO: 106664 - DNA, 1041 bp, Homo sapiens
aggtttttgagatttatttgcattgatatatatagctctcagtcatttacctaactgctaactaatatttcattatatgaataagctgtaatttatatatacattctccaactgatgcacattaaagttgtttctaacttttgactctcacacataattctgctaagaatatcattgtataatctctttgtttatatgtttgaaagctgctataaggggctgaattgcgtattctccaaaatcctgtcagcttcaaaattctatgcttccatatcgtatctattcctcggctcacatgaatccaaattagggtttcttaaaacagtagaagtgttcaatgataattctaataaaacatacacagaactatttttttggatacactgattgctattcagaattatagcggaaagatataaatataagacacagaatctgctctcagtgtttcttactttattggtatgccaacagagtatttcacagttcattgaaaatcgattaaaataattactaggtcattagtgtggactttgagtatgagtgtaaagacctcactcactaaataattcatggcagtcagcaagttaagtcctgttagcaagtattgattcagtaatgtaatactacctagtccaaactacgtaattttcctaatagaaataaactcctttaaatgtcaaagcaccatctagtcccagcctcctcccgaaaagcttaaatttgcatagccagtaggtaacaaaactggaactaaaacagaattcctgctaattgtttttccatgctgattttttcccttcccctcctccacctttgccttcttctttcctgccttcttgagatccaagagggctcaagatcctttggaattattggcttatttcccaaactggtttgaacatagcttttccaaaacctagaattaggaagtttagcaactagatgcaccacgaggagcaagaatatggtttctgttctccagctgaaaatctgtctgctgagaacttactactgtaccagccccagacttcaagagaa

SEQ ID NO: 106665 - DNA, 376 bp, Homo sapiens
tgtacacctgcttccaggtgttactgtaaagttcggccactaaatacgagaccagcattctacagttcctgaactgggtaacatgtaataggaattcagggttaccattttcttctcagatcataagaagttttagaaatcttattttagacactgtgatggcaattcacttttgaaaagaacaagaaacctagtcttttgcaggattaagaactctgtaaatggagtgtatgcacttgaagggagtagacttgggggttcttaatcttttttgtgccatggacccctttggcaatctagtgaaggctagggacccctttatagagtataacattttaaaatatatgaaataaaatatcagtttataaagaaagct

SEQ ID NO: 106666 - DNA, 744 bp, Homo sapiens
ccagttacatgatacttcttaagtgaaagtgtagttagtaatgtgtgtgtcctgttggccataacacaatagtattgtttaaagaatgttaattgagtcacagaagatgtactgatcattttatccatgctcaatatatgataggcagatacattattatagcccaacttttggagatcaaagtgaattattgatgggaagactgtctttcaaagtgatactttcccttaataaagtagacagcaaaggaacatgctttaaaataataaaagccacttatgacaaatccacacctaatatcatactgaatgggaaaaagctggaagcattccccttgagaactggaacaagacaaggatgcccactctctgcactcatattcaagatattactaattgtcctagtctgagaaatcaggcaagagaaagaaataaaaggcatccaagtagaaaaagaagtcaaactatttttcttcactgacaatatgattctattcctagaaaaccctaaagactctaccaaaaggttccagaactgataaatgacttcagtaaagtttcggggtacaaaatcaaggtacaaaaatcattagcatttctatacaccaatgtgttcaagctgagagccaaatcaagaacaaaatctcacctacaatagccacacatacagtatccctaggaatacatctaaccaaggaggtgaaagatctctacaaggagaactaaaaaatattgcagaaagaaa

SEQ ID NO: 106667 - DNA, 144 bp, Homo sapiens
gatccagtgacattgtgagtgaagacgcaaacaggttttgactcctgcatggccgatgacctttttctgtaggcttaccagaaaagtacattccaacagttctttgaggatttaaactagagcagcaaataaagacaaaagatt

SEQ ID NO: 106668 - DNA, 454 bp, Homo sapiens
ggcatttcagctcaactattatgtgctttgagtttgatgtatttttttttagtagtgttttattgttgtaaaccttgagacaggtctttatttttaagccatttttgaatggactacttggcagttttgtaagtaggtgaatcttcctgctttcaatgtggaatttttgaaattgcattagaaaaaacatgaaataagatacacttaatttgcctttgaagatagaatacaaattttgagaacatgtaattaacatctaattggtacacattaacatgagcattatagactttagttactgaagtttaatagcattatatgtattgcagatagaaatttcataagcattttcacagtgactaaacggacttatttttagaggttcttagcttctgcataattggaggctgtatgactaaggcaacattttgccaagtgcaggtaaagtcaagcc

SEQ ID NO: 106669 - DNA, 783 bp, Homo sapiens
cacaatgcctcacacctgtaatcccagcaatttgcaaggccaaggtgagtggatcacttgaggtcaggagttcaagaccagcctggccaacatggtgaaaccctatatctactaaaaatacaaaaattagctgggtgtggtggagggtgcctgtaatcccagctactcaggaggctaaggcgggagaatcgcttgaagctgggaggcaaaagttgtagtgagctgagatcaccccattgcattccagcctgggtaagagagagagactctgtctcaaaaataaataaataaatttcaaataaataaataaagtactaaatgaaaagtaatatacaaagaacatcgaaaatctagaattcttaacacacagagaaaatacccttcaaaactgaggagaaataaactctttcaagcccgtgtggtggcacatacctacagtcccagctacttgggaggccaagacagcctagaaaacatagcaacacccagtctcttaaaaaataaaaataaaaaagcttttcaaacaaaagctgggacatttcattgctatcatacccggtgacaagaaatattaaaggaagtttttcaagcaggcttatgataagcccacatggttagaaaatgaccctctttgtcaacagccatgtgagtaacccacttagaagtcgatcctccagtcccaaccaagcctctggaagattacagtgccaacttagatttttattataacctcatgagggatgctataccagaaccacccagctaagccactttcaaattcgt

SEQ ID NO: 106670 - DNA, 1478 bp, Homo sapiens
ctctcttctgcggtcctgttcaaagcttaagtcagacagtgtcacttcactcgtctgtttaaaacctttcaatggcccccatttcacgtagaccaaagtccaacgtatttacctggcctactgatcttgctcctagctacctctgacctcatctcctgtcaatttccctctcattctgttccaccatcctgactgccttgacttcctcaacagaacaagcctgctcctgcctcagggcctctgtccttattcttcctcttcccaggggtgtgctggtaaaatatttaacaaatagttctccgggacgggggagaaaaccctcatttgtagcatttgcaggtatctatgtgtaaatactctcatcaaggctatttttgagccactaatttgccttcactgaatacagagtttgggaagagatgcatgccatcaggaacaaatgcaagccagcaccagcacaccactgcctcttcctgcaactcttgtccatacacaacctcatggctggctggctcacttcctgcaggtctctcctcaaatatcatctgatgagagacacattccctgactatgctttctaaaataggccatatgcccccacattcataccccatctgctgtcattctttattctttttataagtgcattattttcatagcacttatcactacctgttgtatattaatcaatgatcttttcccattagaatgtaagtttcatgaacaggtacttgttttaatactgtatctccagtcctaatgtgtaacaggagcccaataaatgtttgctttcaaatggagaggttaagtaacctgctcaaatcacacagctattaagtggcagaacaggttttcaagcaatgcatctggtggttttaactaagtcgagatagtttttattcctaatgcctaaatcagggcctaggtagtgagctgtgggcacatattaagtattggttaaactaaaaataataagcaaaatggacattatctataaaagcttttgtggaaatggctagagctagggtaaggaaacaaatttggttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaatgattaaatacccaatgatgtaaaaaacatttataaaataggaaagtaagactgactcaaccataatttgttgagtcaacccaaaaatctatttggttattttcaaacagaaatagcctacagatgatatctgagattgttccaaactttttctatgaatatgtatactttttttacataattaacataatactgtatattaatttgttacctgctttttcaattaacaatatatcataagcatctatgccaataaacacaattctgcatatttca

SEQ ID NO: 106671 - DNA, 1025 bp, Homo sapiens
atgtcagggaactgaaacagcccagcctaaagaccagggcttgtaggcattgccttctgtaaaagggactataaaactccacccactggtccaggaacttgcgtgtgcaacttgtcctctctccaggatcttggacagagagatggggtatagggcatagtaaatgatgtgcaggataggaaaaccctagacctgcatcacacaaagggtgtatggtacaaacttttatactctatcttgtaccagaaacctcaaataaagagcataaatactggcctaggataatagaaatctttcaggctctagcaggaacaaacataaagtccttacctacacaaagccctaactcttccactaaccagccacaccagatgcctgggggccaaggaggaggactcttaagtacggttgcacttacactcaaatagaaaataaaatacagacaaaccacagagggaaacatgccgctgcgcaggaaagatagcactcacaaaactagaaataacaaaactgcaggagaaatgcatcagacagacccgaaccgagggacaaaatacctgaccagccctcctcaaaactgccaagatggtcccaaaacaagggaagtctaagaaacagtccagagaagacgaaggagactaaatgcgaggcgctgttctggatgggatctttgtacaggaaagagacgttagggaagaactagtgaaatctgaatacactgaatatagtgtagttactagtgaaatctgaatatagtgtagttaaaagtaatgcacatggccaggtgccgtggctcacgcctataatcccgtactttgagaggccgaggcgggcggatccctcgaggtcgggaattcaagaccagcttggcctacaaaaccctcccatccctactaaaaatacaaaaattagccgggtgtggtggtaggtgcctttgatcccagctacttgggaggctgaggttacagtgagttgagatctcaccactgccctccagcttgggcaacagagcgagactttgtctc

SEQ ID NO: 106672 - DNA, 706 bp, Homo sapiens
gtttaaatcactttattttattaagaattctgactaaatttttcatgaaggagaaggttgaggttttaattatttataagtttttggattatttgtgaatctgaaggccaagtttttcttataaatttaagatatttcagtttcaaaaactatcctgtatttgagatacgtaaactcatttaataaacctaagtacattgggaaagtgagacagtggggaaaaaaagaaaaaagaaaaaacaaaacctaagtacagcacagattggaaaccccaggagagcatagactgaattcacactcaagcttagctgctcaaatcctgaaactgtcattggtccactgaaggtacaggagtcagaggaccttaattcataaggcaaaggattgtatatatagatataaggagtttgacattttaagaagagtgaattgagcagaaattctccagaagaacttaaagagaacagagtggactcttccccattctaccggttctggccccaaagttataaagggcttggatacaaaggtcagacttgttatcttgttgatgctcagattttctaaataatgaaatgtgtttttgcctttatgacaacaggaaatgctcagaagccttcagacttggcataatttgtcataagaatgtagctattccattgattttgttgttgtcaaatttgtgcattctccattgtaccttttt

SEQ ID NO: 106673 - DNA, 142 bp, Homo sapiens
gagaaatgacattgagatcagttctttcccatgttcagattgccgctaggatgacaggaaatgaggcactcagtgactctcctttcttgtgggtaacaagggatcattacagtctaaatacactaaatggttcccaagtcat

SEQ ID NO: 106674 - DNA, 248 bp, Homo sapiens
ccggagtttgctgcaagattttcacttttaccttagattaaataagagactttttatactgtcgtgcttcaacttgtatttttggtggtgatgattttttctttgttgcttactaagctgatattactcacttgatattgggtgacagcttgagttacaagtttaatactagtaagtaagcattttcttttccttttttttttttttttttggggtttttttttttttttttaataattttttttttt

SEQ ID NO: 106675 - DNA, 511 bp, Homo sapiens
cccttgctacctttcctgaactattctgctagattcagacctcagaaacattgtatcaggaaatacagaaatgttctttcaaaatgagtgtatgggaatatgggaatgcctaataaaatctgtcttcattgattcgttagcaaaaaatcatataaatccatagcttgtgattgcaagcagatatatttcagatcctttctgtgtttgttttttgctttcttgatctatcacaattggagaaaacttaaaatttctcaatggtattgtatttttgccaatttcttattctgctttatgtttctcgttgctatattattgggctaaaatggtccataattacttaagaatcattgtgaaatatattgcttaatgacacaagtaaatctttttcactgtttgtaatgtctttgctcttaattctactttgcctaagattaatatggttattcctgtttggttttatatgtatttattgatttattttgaagatggagtctcgttctgtcgccca

SEQ ID NO: 106676 - DNA, 165 bp, Homo sapiens
gaggaaactgaggcacgggcagtggttcatcctggagtcttagtgccctcatctgtgaacaagggagactggaagccacaggaagccaggaaggatcgcctgtccagtccctgtgtgatggtccagtcacttgtgtgggcgcttggtggctttggaggagcaggt

SEQ ID NO: 106677 - DNA, 158 bp, Homo sapiens
tggggtcaggctcaggccacccacccagacctccggtccagtggcatccaccatgcagatccccagtgccagaacctgcctgcctgggcattgaaggggagctgggcctctaaaggcagaggaactaccagggtcgtgcctgcctccactcacagggg

SEQ ID NO: 106678 - DNA, 350 bp, Homo sapiens
gtgcttttcatattataaatatttgattaatactctttcccttttgaagaagatctacagtttatttcacttctttccgtaaatccatgtagagatccatgattatatgttgaatatatgcctgacagcatgattgctttttctaagaatatgttttccttttaagtactggtacattccaaactacaggttgattgtcactactcaactgaatgctttgggagaacagaatcattcatgccaagcactgatattttccaaattagtctgtggaataaccactaggtataagctttattttagttttttagaattgttttaatatactcacccataatattattagatga

SEQ ID NO: 106679 - DNA, 296 bp, Homo sapiens
tttaaaaaaaaagaaaaataaaataaataaaagagtgcctatctcggatggtgggattatgttatgaggaaattttatttttgctttaaaaacattaattcatttattttactctgagcattattatttttataaacagaagatgtagagttcaagataagaaccatactttcaggatttctagatttatgtgacacgcatgtgtgtgcacacacaacatatggtctctctataattagctattattattaagataatttttcctataatcctgcagctccttgcctagtgctttg

SEQ ID NO: 106680 - DNA, 378 bp, Homo sapiens
cccctgccctcataggttttagattggggcatgtcatagagcaagagtctttctcctccatctgttaaggtcggattatggtgaatacaccattaccaggagactaccattgccacgcagaggaataggttgatatatttttaattgtgtactagggtagatggcatcagaaactgtataacttcacatctgaagcaccccatattttatcctgtgtgtattaactttaagtcactggatattttcttgtattctcagtaaaatgatatttattggctagttatatgccagttttgtggtgttctccctaaagaacacctgttattcttttgaagaacacagggttccagtgatctggaacccagccttgagcactgg

SEQ ID NO: 106681 - DNA, 89 bp, Homo sapiens
gcctgcgatcaccactccgggatcctgccgcagtgcttggggctgtaaccttgaactttcccagcgcggtgacacattctccccgctct

SEQ ID NO: 106682 - DNA, 503 bp, Homo sapiens
actacagctccatgtccctcacctccccagtccccagcctcccaaaaaaacataaagctctgtggaaacacagacacagcaaacagagcacttccacccacatcttaaatctctttgtggctttctttggctttacattagaaatataaagtattagaaacactgacctaaacaagcaaacaaggcccatgtaagtgattcagacccgtgctgtgccttgcttgtttggttctcagacaaccacaaaaattctgaaaacgcactattttaaaatgctcccaaatccatttctgacgagtgaaaattccgccctgaataacgctgagcgcagcatgacgtcagcagcggaagtgggtgggtcaacgacccgggaccctgatggcgagcgccttctgcaacaaaacagctagatctttcctgcacagccagagctccccagcttccagaagcttctctggatgttacacaacaggaagtcctcccgtgggatctgtggggaggag

SEQ ID NO: 106683 - DNA, 250 bp, Homo sapiens
gaataaaacataggagaaaatattcatgaccttgggttaggcaaagattcttagatacaacaccaaaagcatgacccataatagaaaaaaatgaataaactgaacttcataaaaaatgaaaaaaatttgcatttcaaattattccattgaggaaatgagaagacaagccacagactgggagaaaatatttgcaaatcatatatctgataaaggacttgtatccagaatacattgagaactcttacaactc

SEQ ID NO: 106684 - DNA, 319 bp, Homo sapiens
aggagcccacctggagtgtggctgtgacctccagctgcttcctactgtagctaccagatcatgagcttgtgaaacacccctctgatcccatccttcccctgctcaaaagcctatcatggctcccatggtctacagaacaaaacaaacccctcagctggatagacaagccccttccccatcaggccgtcctttccttccaggctggtctccctgaattcactccccataccctaagtccggctcctcacgccatgtgcctgacacttttcccacctccatgcctttccctctgcctggaatatcctactttcgcctcact

SEQ ID NO: 106685 - DNA, 750 bp, Homo sapiens
cctttttgtttatgagtacaaacacaccattgatgtttataagaataattattttctcccctgaatgttaactagccacaaaagctggtgtacacatgtgatagtgtttttcacggagtttaaagaatgttggtctttgatgttctgcccttgaatggaaatgagtctgtattacaaaatcactagtgaggaaaatggggaacttctagacaagcacctgagaagcattattagaattcctgagcattaaaatccaacagatgcatttttcatgacgttaaaaaaaactccactttctggtagtagcccatgtcttatgctacgaaaatgaatgagattaagtagaatatgttaaaatcatattaagtagaaatgtcttagtcaaaacgtgactgaaaggaaaagacactaatacaaggtagcggtagcaaaaaaaaattaataaatagaaaaaattttaaataagctgtaaggaaaaaggggtgtctcatgggaaaagggactaggaacaagaatctaaaaggaggcccttttggtctttctcagaccataaaatctctcatctctacttctttgcatgacttgcattttttttttctttctctcagcctggcttgctcagtttgcctgaccacctggcagaaggtagctacctcatagcattctaggttatgtatcctctttcagttcaactaaagagcccagacagaattagaatctctcagttacaattccagtctcacagaaaag

SEQ ID NO: 106686 - DNA, 265 bp, Homo sapiens
gcacaatgcctggcatacagcaggcatttaataaagatgtgtgaataaacagatgagggaataaatccaacctgcagaaagaactactttacattgcaaagacagtactcatatgtttcagaagttttactgcatacacataaaatccttaccacatgtgacatattctgatttttttattttactgtattgtatgcttattctgtatttttttttttttttttttttttttttttttttttttttttttttttttttttttttt

SEQ ID NO: 106687 - DNA, 458 bp, Homo sapiens
cctgactattcacagagctgttgtgcagtgacagagatctaaatcctcttctctagaattgacccaggatctataaccctaaggaagtattcagtgacaaatctttttcacttgactcccttgattgactgtttcttctttcatctgtttaaaccaaatatactgtatgccaaccatgcacttggcactgtaatgcaaagaagaacatcatatagtgtttgctcacaagtctcattccaaaacattctagaaggcagtacaaaaggaagggttggaagcaaaataaaaaaactttactgtgaaggtggtatttaaaaatgcattttcctatgcaaactatagtcctgttacacaaaagttaaagggtattatgtgggtgtgtaaatacaatagtccccactgtccactgtttcagttacctatggtcaaaaagaaaaaggggaagtacagtataataa

SEQ ID NO: 106688 - DNA, 617 bp, Homo sapiens
gtctctgacagtcaatccaggttttatgttatttcaaaagggttatttttgtcctccttttttaatagcttcaggaaagttaaaggtatcatcttaggtctaacactctagtctttgagagttacggttctttcgtagaacaatttccatgttgttaactgttgtagacttaattgaatcacattttgggaccagatgtatttggggatagaattctttaaatgtatgggacttcatgcttcctgattatgtaatatttcctgtggttgggaatcctagaatgcctgatctattttatctgttcaggtagttttgttattgtaccctcttttgggtcatattctagtatttctcacagggggtatgagaaacagaaagctatatgtagcagctggtcttgagaagtagaagcatcttaactgtcataagagcatagattttttgtttttcacaacagctggaataagttcctgcattataagtataaagggaaccgagatttaatttggagatcatcactgttaaaacgataccagacatttgtcacagtgtcttatttggggaaagtttgctaatatacattttgtctgtgaaaatatagtaaattttaaaatact

SEQ ID NO: 106689 - DNA, 791 bp, Homo sapiens
gccttgttgccgtcccttcgcctccttcaccgccgcagaccccttcaagttctagtatgcgtgaatgcgtctccatccacgttggccaggctggtgtccagattggcaatgtctgctgggagctctactgcctggaacatggcatccagcccgatggccagatgccaagtgacaagaccattgggggaggagatgactccttcaacaccttcagtgagacgggtgctggcaagcatgtgccccgggctgtgtttgtagacttgggaaaccaacaggtccttggtgtaagcttcggcgatgtgcggcactatatgcgcaggcgtctcttcaccactcgtgccacactctctagtcacggcgcagacgcatgatggtcgacaaataaatatgcccgagggcactacaccattggcaaggagatcattgaccttgtgttggaccgaattcgcaagctggctaaccagtgcactggttttcagggcttcttggttttccacagctttggtgggggaactggttctgggttcacctccctgctcatagaacgtctcttagttgattatggcaagaagtccaagctggagttctccaattacccagcgccccaggtttccacagctgtagttgagccctacaactccatcctcaccacccacaccaccctggagcactctgattgtgccttcatggtagacaatgaggccatctgtgacatctgttgtagaaacctcaatatcgagcgcccaacctacactaaccttaaccaccttattagccagattgtgtcctct

SEQ ID NO: 106690 - DNA, 315 bp, Homo sapiens
ccaggatcccaccaggtgcctggttaacttgtctcaaataaatgtatggaatgaaggtgttaaacatagataatgcaaaatatacagttacgtgaagaggaaatctgatgaaggaaaagatgttcaatctcactagtaatcagaagagtgcaaatgtgagataatttttcaactaccaaatgaacaaaggtgaaaaagaatgaaaataccaaagtctgggagactttagggaaatgtaagatctcattggtggcagtgggcactgacataagctttctggaaaacagtttggtaatgcttgttataaatgtaaaa

SEQ ID NO: 106691 - DNA, 232 bp, Homo sapiens
cgtcagagcctcactttgtcatgccagccactgggtggcaggggccagtttcagtgaaggcactcacagccacccttcaaagtccagcctctccttttggcccaagctggccagaaaccgggacctggggtgggtgctggagacaccacagtgcctggctcctcactccacaggaactgctgggcccacctgggctgcactcctcgggaagcaggagcagcagaaactcaga

SEQ ID NO: 106692 - DNA, 487 bp, Homo sapiens
agacagcctttattcaagtaactgaataaacaaaagaattagagagtgtgatgagtttgaataaaaaatatagttcataaaaaccagaaatgtgatagagcatagtggctggaagaaagttacccaagtggcttgggtagtcaatgaagttgactccaacatgcagtagtacttggactgaggccagaaaaattagaaagaggccaggcatagcaactcatgcatataatcccaaccctttgggaggccaaagtggatcactggaggtaacgtcgacctcaagtgagatcgtgtctctaaaaaaaataaataatttatttttaaaattagctgcatgtgggtggcacgtgcctattaatcctagctacttggggaggctgaagtgttgagggccactttgaactcagggagttccagcctgcagtgagctataattacactactgcactccagtctaggcaacagaaggagaccctgtgtctttaaa

SEQ ID NO: 106693 - DNA, 373 bp, Homo sapiens
gtaagcaggtggttgactcccttaccttctgtacaggccagtcttagctggggtgggttgcatttccttgggtgctgcgtgtatgtgtttactggatagcaaactctcggtttgctgtgggttatctagatttcttctctctctcttttttgacacagagtctctctgtcacctagactggagtgcagtggcactatctcactgtaacctctgcctcctgggcccaagcaatcctcgtacctcagcctcccgagtagctaagattacaggtgtgtgctaccatgcccagccaatttttcttatttttagtggagacagcgtttcaccatgttggccaggctggtctcgaactcctgacctcaagtgatccacc

SEQ ID NO: 106694 - DNA, 389 bp, Homo sapiens
tttgagacagagtgttgctcttattgcccaggctggagtaatggcgccatctcggatcctgggaggcggaagcctcccaggttcaagcaattctcctgcctcagcctccagagtagctgggattgattacaggtgcccgccgccaacatgcctggctaattttttgtatttttagtagagatggggtttcatcatgttggccagactgatctcgaactcctggcctcagatgatctgcccacctcagcctcccaaagtgctgggattacaggtgtgatgacatcacttttaatggcaagaaccgcaattagttttgcactaacctaaatactgtgttcctttctccattcagtagctgcaacggccaccattttggaccactgtatagc

SEQ ID NO: 106695 - DNA, 320 bp, Homo sapiens
tttgctggggatgaaattactttgtcttatgacacatggagcagatgctactaattaacacacataaatgtctaaaacagagctttaaaaaaacatatgcatttggaaacagaagtagaaacagcttcaaagagtataagcagaatggcataatacaatgaatgaagagtatgtttttttaagaaagtcaatcagattcgcaagtgaattttataggcctctctctaaataaagtaaggatttgaaggaaaatgtcttgcttttaatttttttgttaacggaaagagggcagcccatatcatataccagcacaagaacca

SEQ ID NO: 106696 - DNA, 318 bp, Homo sapiens
atggttcttttagcccagaggacttccatgagcagaactgaggaaggagataggctgccctttggtcacagactctaacttggaggctcttccagggtcttgtctagggctctgctctggctgagggtggggtggggtgctcaggagccaggagagaaaggtggcgtggacaggcccacagtcagcttgcctgcacccagcattgtcggctgctgccctgaccacctcccccgccccctttggcagcccagagctggggtgcgttaagcactgtgcccccaccgccatggtccatcccccacacctgcctccctgact

SEQ ID NO: 106697 - DNA, 606 bp, Homo sapiens
ggtccctgtccagaaagagttgctgataaggaaaacagttaattcataggctaattcacactacagtgatagagattgatgtcatagtactctattcctcttaggtgtgtttgcatattttaaaagatgctggaagagctgctttatccatgagaaatagacttttaatgctaaaattttaatattgaaatctacgggtggggtatattttaggaaccccatatctgttctctgtgtctctgtgcgtgcattgctttttcattttggctcctagactggggctcagcttgagcttgcacgttgctgctgcctttaaaacaccgctcccttgtcacatgcagaggacgtgatggctgcctgtctgtgttaagtaagaaggaaatggagcccccccccgcatttgcctgccacagctgtggcagcaacctggacctggcactgagagcatgtccctagcttgacctcgctcctggaagccaccttagattatgtccagccataatatgacaggttggctggtgcaacatttggagctctagttcccatcttggatactgaaagccttcatggaaaagcagtgtaaggtcaggcctgcccagtgtgttt

SEQ ID NO: 106698 - DNA, 1339 bp, Homo sapiens
ggcgattggggcgcgcgcgcctccttcggtttggggctaattataaagtggctccagcagccgttaagccccgggacggcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatcttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcataaaaaaaccttgtaa

SEQ ID NO: 106699 - DNA, 491 bp, Homo sapiens
gcgatgccaaccaaggctgtgcgcccgccccgggcattacaggacgcaggaccccctcctccagaggtcctcagcaaaatgtacagaagcacccccgcatagatcaattcattcattcaacaaatgaatatttgatggaagaggctccagatggagggaagagccagtgcaatgcctcaaaatggagacatggtgtattaatggagaagcagcaggacttgtgaaagcctgggacgagggcttggggttttattctcaatatgatagaaaatgattcaaggctgagagcaggagagtggcaggatatactgacttatttaaatctcactgtctcccacaaagaacaagttttatctctcctcatgctcctgagagaagaatgtactgcttatctaccatcatttctgcatccatcgaaacatctgggtttacctgaaaagaaattatataaaactttcagtgttttctaataaaaatgcaatgaatacaat

SEQ ID NO: 106700 - DNA, 844 bp, Homo sapiens
ggcgattggggcgcgcgcgcctccttcggtttggggctaattataaagtggctccagcagccgttaagccccgggacggcgaggcaggcgctcagagccccgcagcctggcccgtgaccccgcagagacgctgaggaccgcgacgagtcgtgtctgaacccggcttttccaattggcctgctccatccgaacagcgtcaactccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggattgtgggggaggagaagaggaaggctgctctttccagaattttccatactgctttttatgctcttgttgttatcacttattactattatcattactttaatccaggtgatggaatggcacgtgtagtgttagcaacttgaaaaaaatagataataagcaaccatcaataaaaatagtcttatagaaaggcattttgcataataactgatttgcattggaccctacatttagggttgttattgtctcaatgacaaaaggtttacttagtgactgtctcgctagaattacaacattctgggattttggctcggatgcaaaagacatgtgagaaacgaggttgcctagccaaaattatgtagtgaaatcaatgtaacaaatatttattgagcttctaccatgagaaagacacttatgattggtactgtggtggatgcagagatgagcaggcgtgctatggctgatgtccagatagaatttcccatctaatgtgatcttgacca

SEQ ID NO: 106701 - DNA, 1215 bp, Homo sapiens
gtcgcggcgagggtcctgccgagggacccgttctgcgcccaggcaggctcgaagcacgcgtccctctctcctcgcagtccatggcgcggttcctgacactttgcacttggctgctgttgctcggccccgggctcctggcgaccgtgcgggccgaatgcagccaggattgcgcgacgtgcagctaccgcctagtgcgcccggccgacatcaacttcctggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatcttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcataaaaaaaccttgtaa

SEQ ID NO: 106702 - DNA, 1057 bp, Homo sapiens
cactgactgaagtcctgccctggctcttagcttcggggatccgcgactatctggggaccggcttgcgtaatggaatgtgaaggtaaactgccttctctgaaaatttgggaaacctgcaaggagctcctgcagctgtccaaaccagagcttcctcaagatggcaccagcaccctcagagaaaatagcaaaccggaagaaagccatttgctagccaaaaggtatgggggcttcatgaaaaggtatggaggcttcatgaagaaaatggatgagctttatcccatggagccagaagaagaggccaatggaagtgagatcctcgccaagcggtatgggggcttcatgaagaaggatgcagaggaggacgactcgctggccaattcctcagacctgctaaaagagcttctggaaacaggggacaaccgagagcgtagccaccaccaggatggcagtgataatgaggaagaagtgagcaagagatatgggggcttcatgagaggcttaaagagaagcccccaactggaagatgaagccaaagagctgcagaagcgatatgggggcttcatgagaagagtaggtcgcccagagtggtggatggactaccagaaacggtatggaggtttcctgaagcgctttgccgaggctctgccctccgacgaagaaggcgaaagttactccaaagaagttcctgaaatggaaaaaagatacggaggatttatgagattttaatatcttttcccactagtggccccaggccccagcaagcctccctccatcctccagtgggaaactgttgatggtgttttattgtcatgtgttgcttgccttgtatagttgacttcattgtctggataactatacaacctgaaaactgtcatttcaggttctgtgctctttttggagtctttaagctcagtattagtctattgcagctatctcgttttcatgctaaaatagtttttgttatcttgtctcttatttttgacaaacatcaataaatgcttacttgtatatagagataataaacctattaccccaagtgcataaaaaaaccttgtaa

SEQ ID NO: 106703 - DNA, 523 bp, Homo sapiens
  misc_feature (495)..(495): n is a, c, g, or t
tactgtgccctctctcactagctcagtgcccaccatggcttcatgtgccttttgatgcttctaaatcctttcttgcatatctgctacttctgcactcttcccactctttcttctttcatctgtttttgtgatgacttctcagctttgatgatgaccaagcactatttctccttttttgagatgaagtcttgctctatcgcccaggctagagtgcagtggcacgatctcagctcactgcaaactccgcctcctaggttcaagcgattctcctgcctcagcctcccaagtagctgggattacaggctcccgccactgtgcctgactaatttttgtatttttagtagaaacggggtttcaccaccttggccaggctggtcttgaactcctgatctcgtgatccacccgcctaggcctgccaaagtgctgggattacaggcatgagccaccaagcccggccctaacagatctatttttgtaaacctcctcaaatgtttntcctaaaaatatttgaggaggtttacaa

SEQ ID NO: 106704 - DNA, 383 bp, Homo sapiens
aaaataataaaataaaatataaaataaataaaatgcaaggagaaaagctgttccagtgggaaaggcagggaggcaggaattacacgcagtgatcatgaactgcatgtatctaggccttatctctcaaattgtaaagtcacctaaaaggtagacattttctaggtacagctatgatatagaatttagactaacaaatgtctctctctccctcttccctgcctcccttttattccatgcttacagctaaggaaaggtgagtgagcctcttgaatgtggccctgatttgtcctatgctctgggaccttctcctccagcacaaaaccctctttgagtctttgcacatatcccaagctctcctgccggctcaggaggcacatccgcta

SEQ ID NO: 106705 - DNA, 820 bp, Homo sapiens
aaaatctggagggaacaagaggattgaatgtgacaaaacctgctgaagagaggcagggagggaactttcacctttatgtcgtaaacttctatgttgtttgaattttgtacaacaaactatgcattactttgtaattcttaagacaaagaatataagtaagaaaaacacataccaatagagttattctggcacacaacctggtttacattttttgaattattatttctaaactatacattggtgaaaggagatggaaacattatacaacacacaacacaaaattatgctctattccagctctgttgtcccctgtcctctgtaagaacgcaaggcctgcagatgttccccaaatggaggtccctaggacagcaaaggtgcccctcaccaccttctgtcaccttcaccccacccttttcctccctccttcagccccttgatgtttctaattccgtcctgtctcccattcaaagtttctatcttgcccttttccccaagttgctatcttctgccttagaagcaagtcccaaatttcctttcatgttttacgtattttcaccaattctggtgtccgttgtaaatcaaaattgctgtctttctcacccagttctgctgttttaagcccagtagttagggtcagaagaagaaaaatgttgcctgagtccccatctgggttatagtttgtttggggggattattatcctcacccatctaaaattaggcataccttgctctgcctgcttcagtttctctccagaaacattacatcttcctacaagatctgcttttccctactactgtgtttttgaacttatcctgaaag

SEQ ID NO: 106706 - DNA, 216 bp, Homo sapiens
tagctttctgagcctcagttttgtcatctggaaatggagataatataaccacctacactgcagtataattatgaagattaagagtataaaattctcagccaggcatgatggctcacgtctgtaatcccatcactgcgggaggccaaggtgggaggatcacttaagttcaggagtgtgagaccaacctgggcaatacagtgagacctcatctctatt

SEQ ID NO: 106707 - DNA, 556 bp, Homo sapiens
gggctcaagttccacattggtatcaaccggtacgagctgtactccagacacaacccggccatcgaggccctgctgcacgacctcagctcccagaggatcaccagcgtggcagattttactggcacctcctgcatgtcagaccccctttctgggtggtggggagttgaggatgagttcagcctcaacgagatctgctgcctctgtggacctgacagccccaggaagagacacacacgcacagtgcccaatcctgaggaggaacgagcacttcagagccgtgcacgccagccaggccgtgtggagaggagggggctccactgggaggggctgaggaccttccacagggtctgtcgggcagcttaccttccaggtgggtccgtcttggcagggagaggaatgagagagccgtgcacaccagccagggcgttcgggaggagcagcacgcaagttagaaagtccccagtgccgctgtccgtatgagcttctctccagctcattttccccatctgtccagcgggatctcgctgcgtgggaccaatgcaaggataggatgaga

SEQ ID NO: 106708 - DNA, 393 bp, Homo sapiens
aaaattgctagttaatcaaatccttggatgaaagttggctttagggatcaatgtgctcatctgttacttaatcctaaatatctcaagagttgtgctgtgtcttttacctcttttaggtaatctgcaattagaagcactagttttagggggtgtgtatatcatttctccttttttttcttttcttttttttttttttttttgagacagggtctcactctgtcacccaggatagagtgcagtggctcactgctacctctgcctcccgggttcaagtgatttactcgggaggctgaggcaggagaatcgcttgaacctgggaggcagaggtttcagtgagccgagattgcgccattacattccagcctgggcaacaagagcgaaactctgtctcaa

SEQ ID NO: 106709 - DNA, 377 bp, Homo sapiens
taaaaatcttgagatggtgacacaccatatccctttagtggaggaatgattcttggacagacttccaaggtctttagattattctatttaagtactaccttttggtaaaaaatacttcattttaaagatgaaatctaaaattccatattgtttatgttcatttcataataaaatagcaattgtaaataaatagcaaacttatttctttggcttatcttttaatttgttgcatgtgtgatgtttcgattagaagatgtacgtaggaaaaagcacttagtgatagtataaagggataaaactgagaaaaaatgttgctatgtgttattgtcgtaaacttttaaataatgtgtatctttctacttgtttgtaaactctga

SEQ ID NO: 106710 - DNA, 567 bp, Homo sapiens
tggcaagttcgcctacgagtctctaaacggggtctttctgactccgaaactaacagatcttgactccagaaaagcgtcctgcctgtcatttatgatatttgtgaaagacctaggaacaactgaagctaacacctgagatactgaaggcctggaagagttaggtacggctgatgacactgttgaaaagtcataaacgcacccaagttgagcaagaactgtgttggcccgtgtgtgagaaaaaatagccacgtccagactgggagaatttactacttccaaagacaagttaatagaagcggcacaggacatggaagtatggagtggacaggttaccatttgtacgcggtgattgtatttttaaatgtgctgtaactagcagccatttttattaatgggccaatctaaacagggttgaaaaagattaaccgtgacgccaccccaaattacaatagggtcttgtagatctctttttatagctgtaaaaacggaatcattcttggctctgtgtaatgtttataaggcgtgtctgatctcactgaataaaattttatagaaaagttaaaaatt

SEQ ID NO: 106711 - DNA, 405 bp, Homo sapiens
ataaatataaatctggaggaggaaaaaaaaaaaagaagtctagcttctcattagtaggacagcgttctcattttataagaccttaatacccaataggaaatggccgtcaattctgttcatttcatattctcacagcctgtctctcaggtgggagaacacagctaattcttagggtaagtgtcctcttttagaataaaaccttaccaaaggagagctgaaatgggttgtcccccaaggctgggagatgtgtttggttccctttgcctcacttcgacctttctgaaatcaagaaacaaacaaaatgaaatcgacttgtgaaaggatgtcaaaacgacatggcaaattcagttggtttgttcagaattttcttcctgtatttcctttttgaagttacaacagtcattc

SEQ ID NO: 106712 - DNA, 992 bp, Homo sapiens
cgcatgtggcgactgagcacttgaaatgtggccagtgcgactgaagaagtcaattttcaattttatttcactttaaccgattgacgtgtaagtgtatgtggccgcacgaggcgtggctaccctattggacagtagcatgggtctagatgtttgatccatggttcaacatccccaggtcctggagtctctgtggggctcctctggaagcattttgggagatagtttaaggagaccactagtgctcacgcctggcccttgggcatgtattgtgtcctgattctgggaagagcgtgggccttgatgtcagacctgaggtctcatcccagcctggctaagtcatagctaggaaatttcagattcttgtcctctccacattttggattccccttctgggaatacgtgggggacagggagtgcagtagctcatgttgactggcaagcccctggcgtagggaaggtgtctcctttctgctgggagcgctctccagccactcggtccccgggacagtccatctcagcctctatactcacacctcagcgtcgcgcccagctcagtgctgttctcagctcaaaacccagtcagaatggactccagctgaccttttgattttactctcagaaatctgagactgccctccaaggtcgaagtgtcaccactggaaagggtccctggctttggagcctcctcccgaagcctggcagcagtggcagcagtgtgtttgccttggattcgtttaaaaaaagaaaaaaaaaagttggctcttctactttttgtgtgtgtgtgtgtgagacagagttgttctgtcacccaagctggagtgcagtggcacgatctcggctaattgcaacctctgcctcccaggttcaaacaattctggcgcctcaacctactgagtagctggaattacaggcgcctgccaccacgcccggctaatttttgtattttcagtagagacggggtttcaccatgttggccaggctggtctcgaact

SEQ ID NO: 106713 - DNA, 396 bp, Homo sapiens
gagaaaggcctacaacagagacagggagagcagggagagcaaggaagaggaggtgaggtgtgtaacagagtgagggaatgaagtcatcgaggcagaactggttctagtcctaccaaatgactgaagaaggtgggggcaaagaccacagccctccttgaaggaagggacagtgtttaattcctctgtatccccactgcctagcatgcagccaggaagaggagggcctcatatacttatgattacatgtttattaaccaaagtcaggtcaccataacaacagtaggaccatcaaacagggggaaaattcaggaagtggagctggctggggacggggagcagggaaagacaatggcaccaccggggaccttcagatgaagaagggtgacacacagccac

SEQ ID NO: 106714 - DNA, 716 bp, Homo sapiens
gatggggactaggtgagtccttttattgaggggcagcagagttaataaagttactctggctttctccactagcgattatttttatatttcgagtgggttatttcctctagtaatggatataagttttggtttaattatttaaaagtgaattcagttaactctggctcatgaatgtgctttttctaatactgagtctgtgcttaaacacaaatcaaatttaatttaaataagatccagatattttaaagctttaattttagtatttatttcaataggtaatacacgtacatggctcacaattcaaatttataaaagggtatgcagtgaagagtatttgatatcttgatggtttctgaaggttcactgagaaagctgtgcagcattacattgttggtcccaagcttgggtaaagatgatcatcaatgtgcgtcattactaatgaaaacttagggcctaaagctaacattctgtgagttcttattaccgatcactatactattgccctgagaatgttccagtgacagaatccgtgatcatgttttctttatactactgtctagataggaataactggctgcttgtaagacttagaaaagaagagtaactttccaccccgtaaaggttgtttagtcatcatctagaaagttactaaagatgagaatggagcttatttttataccttatgatttactcaccttctatcaagaatctagtaa

SEQ ID NO: 106715 - DNA, 259 bp, Homo sapiens
tgggtgatctgaggattaccgctctcaccacccccgctctcacccaggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggagggg

SEQ ID NO: 106716 - DNA, 296 bp, Homo sapiens
tgtactgtgcagttggagtagagagattcctgttttaaagttttctaagtttgttttttttggtccttttgctaaaaagaacagacatttgggggacattttggctgtgcctataggcatttccagtttgctgacttcttcagcccaagactgggatatatgagcaaagagaaaacccagggacctcacagctatgccattccagagatctcaaggtccctaaccagcctgctgcttctctccacctttcagattcattttatgtttgttttatatatgtgtccaaggttgttggc

SEQ ID NO: 106717 - DNA, 319 bp, Homo sapiens
gtggtgtgatcatagttcactgcaacctttaacccttgagctcaagtgatcctcccactttagccttctgactacaggtaggcaccaccatgcctggctacgtttttgttcttttagaggcagggactcgttatgttgtccaggctggtctcgaacttctgagctcaagtaatccttccacctcagcctcccaagtagctgggattacaggcacgcaccaccacgcccagctaaaagtatttttaatgcaaaatattcaatccttgcctcagagattctgattcagttgatctcaaggccaggaatcttttttcacaag

SEQ ID NO: 106718 - DNA, 203 bp, Homo sapiens
ggaggagggtcactgttacaaggccgagcagaaatgaagacgctgcccaggatgaactctctttaaagactcacaggctggagtctcaaagaacaagcattttcatggacactaactatctctgtgcctatggagtatctcagctttctgttcaaaacgtctatagaatccatgtctgacaatcaaacattatgctttggaga

SEQ ID NO: 106719 - DNA, 385 bp, Homo sapiens
gctgcgtgggccctggctcacacgatggcgagcgacagagcaacacactaaaggagaactcagggctttgatcatttgcctggctgagccatagggctggctctgagatgcctgtgttccaaacacttattcaaccacatataaaactcatagcatgttcaatgttactcttgggacacttggtcaatttcagaattccagagcaactgtgaaccttcttggaatgattttatctctaaggcaggcaggaggcagggcagtttgaaaatagagcatgagatttgaagtcagatagagctgggtttgaatctgcattctgcctcttacaaataagtgagcctttaaaaatgtaagtcatcctgggcatggtggctcacacctgtaa

SEQ ID NO: 106720 - DNA, 362 bp, Homo sapiens
tgcagttttgttctgatgttccagtgtccatactgaaaggcagtgtgtgaagacttgccatatccccaccctctttctcatcaacacacacccaagtgcacacacgtgcgtgtgatcacacggaaacagttgagaagatgcttgggtggaatccaggcttggattggaagccaagccccccacttgccagttgtgacctttaacaaggtagctgactactcaaagtcagtttcctcacctaggaaagattgggcaggtggctgaccagatgaacgtgattgtcatctgtaaaaccatgaagttccagggaagtgttggtggacatttgcatgtttgtgacgtgatggccaccatcctactgc

SEQ ID NO: 106721 - DNA, 200 bp, Homo sapiens
atcaaaagttaagcagcccagcaatgctctggaaaacagtcacgaacataagcacatgcccggagatcacaacaagtgcttaaagaaaaggaggctgaggcgtaatgacaaatgaacactgagccaaacaaaagacacgagcaaaatactttgctctatcgtcattatctgacttgattttccaagaatcgatttttttt

SEQ ID NO: 106722 - DNA, 561 bp, Homo sapiens
tgtaaatttgtttgagttcattgtagattctggatattagccctttgtcagatgagcaggttgcaaaaattttctcccattttataggttgcctgttcactttgatggtagtttcttttgctgtgcagaagctctttagtttaattagatcccatttgtcaattttggcttttgttgccatggcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatcaagtttcagctttgtacatacggctagccagttttcccagcaccatttgttaaatagggaatcctttccccatttcttgtttttgtcaggtttgtcaaagatcaaatagttgtagatatgtggtattatttctgagggctctgttctgttccattggtctatataagaaataattctctctttgacatgggctttctttttaagaacccaaggcattgttttgt

SEQ ID NO: 106723 - DNA, 783 bp, Homo sapiens
agcaatcgcttttttaaaaaatttgtgtaagcatactttctcagtttatttttttctcccctcccgtttatttttaatctgagttatttcttattaaaataacttttattaaaataaacttactagtctgtcatatcctcaaaacttgttttagaagcatttgctccaacaattacccttaagttatgtgatgaatttgtatgatagcgaataatttatgatcaagtggttctagagtattttaaatgtgtgtaaatagctatgagcctattattttaaaaaaagaaaaaaacttgggctctctatgcctaaggagttaaatatgtctaattttattatctgccagttgtatattcagttctttttataacactatgatttccttaggggctctggcatgtgaatttttaaaacctgtaagttataatgaaaggtatcaagatcccagatgttgggtgaagatctgccattccccttggtgtagtatctatggcattttcatcttcgttttcaataccaagtgttaattccatcccctttggattgtataccaccttgttatcttttatggacacatttaacacctacctaatcaccagggaaatcagctctatcagtgtcattacaattcatttcagtaaaagagaaaaggaaaggtcaccctctttgagagattctagggctttcaggaggaggagaagcaggagacagagctacagtctattcaaatcacaactatctccaaatcatttgtgttatcaggagcaggtgtttatatatttg

SEQ ID NO: 106724 - DNA, 693 bp, Homo sapiens
agcaatcgcttttttaaaaaatttgtgtaagcatactttctcagtttatttttttctcccctcccgtttatttttaatctgagttatttcttattaaaataacttttattaaaataaacttactagtctgtcatatcctcaaaacttgttttagaagcatttgctccaacaattacccttaagttatgtgatgaatttgtatgatagcgaataatttatgatcaagtggttctagagtattttaaatgtgtgtaaatagctatgagcctattattttaaaaaaagaaaaaaacttgggctctctatgcctaaggagttaaatatgtctaattttattatctgccagttgtatattcagttctttttataacactatgatttccccttggtgtagtatctatggcattttcatcttcgttttcaataccaagtgttaattccatcccctttggattgtataccaccttgttatcttttatggacacatttaacacctacctaatcaccagggaaatcagctctatcagtgtcattacaattcatttcagtaaaagagaaaaggaaaggtcaccctctttgagagattctagggctttcaggaggaggagaagcaggagacagagctacagtctattcaaatcacaactatctccaaatcatttgtgttatcaggagcaggtgtttatatatttg

SEQ ID NO: 106725 - DNA, 558 bp, Homo sapiens
ccctgtgtgaccgagccccggagcccctctgttggttcaagatcctgcattggggctgcagaagcggctggcccagtggcgtggctttcctaggacagaaggattgctccaccctacaggggaacaaatgtccaccttttaggagacagaaaactggctgttgtatccaaattaccgtttttctagcccgcggtttctgaacagtttcgtggatcttaagtctgagtttcagttaggctttcctccccactggcatatctgcaggaaggacagtcctagctctggatatttctctgcccccttttatttcttgctgtatgagtcactactctcccccggtgcattagtttcctggggctgctgtaacaaatgaccacaaacttgccagcttacaaccacagaaatttcttctctcacagttctggaggccaggtctggagtcaaggtgtgagcagctacgctccttcctaaggctctggagacaccccgttccgggcctctctcctggctcctggtggctgttgcgagccttggctcatagctgcatcactccaatct

SEQ ID NO: 106726 - DNA, 681 bp, Homo sapiens
aatatacaaaaagtaaaatgcaaacttatgaacatatttctgccaataaactaaaagtctttgaaaagatggaccagtcatgagatctatttttcattatatcaattcaataatttaaataattgatcaatactctttttttttagatggagtctctctctgtcgcccaggctggagtgcagtggcgtgatctcggctcactgcaagctccacctcccgggttcacgccattctcctgccgcagcctcccgagtagctggcactacaggtgcccgccaccatgcccagctaattttgttgtatttttagtaaagatggcatttcactgtgttcgccaggatggtctcgatctcctgtccttgtgatccgcccgcgttgtcctcccaaagttctgggattacaggcgtgagccactgcgtctggccaatcaatactcttaatacttgctaccaagagacttcagaaactgcagtgaaaatgaatgcaaaaattcttgtcaggtagtggagtagaaaatattttatccctgaaaactcataaccatgcagattttcagctagaattcccactatctgtggtgtttgaaaaattgtggttcttgaagtcaagagtttagtttagataaaaattttctctgaatgaagttacctgaacttcaaagtattcctcaaaataaattct

SEQ ID NO: 106727 - DNA, 432 bp, Homo sapiens
atccaggtgaggcaccagccagaacgcctgatcgcaggcacatacttctattctacaccctagtaggctcccttccctgacaccccctctacagaccctgggtcttttctttctgacctttccctgctctgttccttccagggctcttgtcaacacctgacctcacattctatatctctttgtgtgtgtgttttcctcttcatgacagcataagctctgtgatgactgagacttgtctgatgcttgttgtatgccattgactaaaattgattgcaaatgcttgtggatgagttaatgagtgtatctggtggttatttttcaacttctgattggtgagtaagggcagcatttagtttccttgttatatttttatttggagtgtcatcctaatgcagttctgatttctatcatttttcttttttttcaaatggt

SEQ ID NO: 106728 - DNA, 728 bp, Homo sapiens
tggtgaaagaagacagatgcagtgaggtatcgctgacctagtttttagataggctttcttgagtaaggtgctgttgcagaaacaagcctaacacttcttgtaaaagaaaatagcctgcattgtgtgcactgggtaacagaggtctaacatacctgcaatgacccgtggctacagtttttatgaaattataaaacagactgtaggacattttctgtgaccgcacaagctgtttagttaactactgatgccattgggttatacatctattcctttggctgtccttgcacagaattttgtcattgtcattaccagcatacatgtattaggatcatctgggtcctctcacctgaagcacacagtggaggacacaaggagggagagcatctgaccttggaacttccaatgtttatgatctggtgaaggagcaactatgaacctttaagtgaggaatgccaaatatccacatgatttcattacgcatgctctgcatctgggtagacagaaactagtgatactggtagattttgtgtcacccacggaaggtttctaggatgaggaaacttttatttacattcttccttatttcattatatcttggtccttgaagtgccatgtttgaatcaagaatgttcacaagcagtgtcataagaaaaattgttgagaaaactggaggcacttagattaaatactgtctttagagaccagaaagagggccacatagaagaaga

SEQ ID NO: 106729 - DNA, 476 bp, Homo sapiens
gtagagatgaggtgggaggattgcctgagctcaggagtttgagactagcttgggcaacatagcaagaccctatctctgttttttaaagaaattagccaggtgtggtggctcatggctgtgggcctagctacttgggaggctgaggcaggaggattgcttgagcccagtagtacaaggctgcagtgagctatgatcactgagctccagcctgggtgatagagtgagaacctggctctctaaaaatttaaaagcaaaaagaaaattacttcagttagttgcaaccagtccctttccccattctctatacagcagtgagaactttctgcatggggacaatccagatccctgccacacatctgacttctttgtaaacatgtgaccatcacctgtgatcatatctttaaccctcacactcccccatcctaaccttcatgaaatgctgctcatgctctgagctagtatctctcatctaaccc

SEQ ID NO: 106730 - DNA, 328 bp, Homo sapiens
ttgtagtggcggagtttcacaaacaacaaccacagaaaaaacaaaacaaaaacaaaaacttggtctccaactcctggccttaagtgatcctcctgcctcccgcgcccagccttctctttttttctgactctctgttgaatctagtccatgtggcctgttactgataatgaagcacagacgttaagtattgcccacaagcaaggcttacacagacttctgaacagtcagcattcaaagatatctaacagaatagctaggcaattggcttaagagcttaaatattgtgcatgagagtgacttttaacaacaggtccttgctaacaagtct

SEQ ID NO: 106731 - DNA, 594 bp, Homo sapiens
ctgaggatccgtagaagatggtggtcagtggggctgctggtactttgcaaatctaaccctaatgtctgttggagaaaggttctgattaaattatcctttacatcttatttttctggcctacaccttgaccttgactgtaaaagtactttctgaacagtttgattttccaagcagtttaaaatgatcatttatgctgggtgccgtggtaacaaaagtaggtcattattatttggttgtacgtcttctggagtccattagaactgtcggttaactacctaagctcaaattcctcagaaagtgcatgtttgttatcagccacacattgtgtggagggaaaggtagcagttctgatttcaaatgcttcttggatacttcaagaatttcttgcgctttttaaacaaattccttcctagctgcagtgaacaacctatagtatatcgaggtcacagcagtgaaaccccacagaaaattcattgtgcttcagccttaggcattgcccataggatgtaatgctacaactttttaaagaggcagtttttaaattgtactttatataggaatgggaatgagagatttctcccttctactatcgct

SEQ ID NO: 106732 - DNA, 179 bp, Homo sapiens
tgtattacaaacttttccaaagcagggactgggactatgcctgactcgactttgtattctcagtgcctggcatataatgggttctgagtagctgcttttaaatgagcaaataaacttaccagtatttttttaaatgacatgaaaataatacacattgtatattaatatgacaaaagaaa

SEQ ID NO: 106733 - DNA, 145 bp, Homo sapiens
aaaaattctgcaccttttaataggcagaaacacaaggaattcagcgacattaaattatcaggtaaaaatacccatgaagcagaggtgcttctaagcccaaaaaaagttatggcaagagaggaaatggagaaattaaattcaaagg

SEQ ID NO: 106734 - DNA, 157 bp, Homo sapiens
tctccacctcccaaggctccaccagttaccctcttttccacggtttctttttttcctattgactgtttccaatagcatttaaatatgcttgaaattttcccatcttaaaagaaaaatcccaggccgggcgcggtggctcacgcctgtaatcccagca

SEQ ID NO: 106735 - DNA, 384 bp, Homo sapiens
ccgaatttggtgctgttgataggaaaagaagttcaaaatcttaagccaaagaaagaagtaatggagttatttgggattgatgcattactatgttttgaatttacgaactgtttagattgtcagggagacgaggaagttaagattgtgtcatgtattaatttgagagtacagtgaatagaataatagtttgtatttacctacagggactcaaaacaggttataataatttttcattgccttgatatatcctggattggatttgagtggagagagacagaacccagcagaaatgaagaaaggagataatgggaaaagcagtagacggacctggttacaacgtgtaacatttttagatacttaaacaataatgagtacttgtacacc

SEQ ID NO: 106736 - DNA, 467 bp, Homo sapiens
agggctgctctcaggaccagtacatttactataaaaattatatatacacatgagtgataccttacagcaggcaccaatcatgagccaggctttacaaaacaaggtgctttgcttacatttaatgtaattcccatcattaccattacttaatagatagggaacctgaagcactgaggagttaagtgacttgaccaggccctatgatcagtaaatggtgacagtaggattccagttccttccacctagctctaaagctgtgctttttttctatcacacatgggtgcctccccctcaggtccctcagtgtgttcttaaagcaggacactatttgatactcctgccaggaatctgcagcctcaggatatggcatctcaagtgccctctttcttggccaccctcagctatttagcacaccaggaatcaaccaacaatgccttatcagctgccaagggaaaggaaggtgcttt

SEQ ID NO: 106737 - DNA, 412 bp, Homo sapiens
attttagaaaacgtatgtatataaaaacataaaacaaaatacggtgatcttcctacccagagacaactactgatatttttagtatatatccctcattcctggtctcgaactcctgagctcaagggatcccccctacctcagcctcccaaagtgctaggattagaggcatgagccactgcacctcttgctttttttatacttaatattagcatttacttcttttgtgaacctcttgccatgtttgctgtttttaatacatgtagttacatagtcataggttgcttaatgacagggacatgttctgagaaatgggttgttaggcaatttcatcattgtgaacattatagagtgtacttacagaaacctagatggtatagccaactatgcaccaagactgtatggtacagcctat

SEQ ID NO: 106738 - DNA, 408 bp, Homo sapiens
caacatacaactggacacaatataattgtttgactaacaactcgtcatttttgcagtacagctactcaattattgctatgactgagcactaaattcacattgtaaattaaaatataaaggttgtttaagggagcaaaatgttcatgaaatagaaatattgagaaaaccaggcctttaaagatgttcacagatggtaacagatactttgtgttgtaaaataaaatgtaacatttcttaagtgcaaatatttctcctacaacacattcacacattgtaatccaccaaggtttattttatggtatttttctgctgtgccagtatgtcagttcatagtaatttgtaatatgcttataaaaactgtggaaaagagttcttgactgctatttttggtaagcatgtaagaacact

SEQ ID NO: 106739 - DNA, 341 bp, Homo sapiens
tagatggagtctcactctgttgcccaggccggagtgtagtggcgcgatctcggctcactgcaacctccgcctcccgggttcaagcaattctcctacctcagcctcctgagtagctgggactacaggtgcgtgccaccacgcctggctaatttttgtatttttagtagaaacagggtttcaaaatatcagccaggctggtctcaaactcctgatcttgtgatccgcccaccttggcctcccaaagtgctgggattacaggcacgcgccactgctttcggccaagttacttaacattttaacacacaggtgacagtatctatttcataagactgctgggggaa

SEQ ID NO: 106740 - DNA, 940 bp, Homo sapiens
cttttgaaaaactttaaaacttacagaaaagttgtgacaatagtaatgtgaactcttgtctagctttcacctatattcatcagttataaacattttatcatgttgcttttttctttatctttgcctatataactggatgtatatctagagtttttatcttggtgaatcttttgagagacttacagatatcatgactctttaccttaaatacttcagcacatatcaccagagaaaaaggactttatcaatgtgatcattcatggaacgatgattaaattcaggaaatgtaacattcattgttaattgttgaagcaaatgccaaggcagaattacaattgcacaaaagtaaaaggaggaagcagggttggacagatgagactatcagattgtgattatactttgtctgccagctccaggggcagatccggagtcaagatggttcattagaggagcttctcattgggcagaaattggtctataccactacctttcttagttataagatagctggaggctgtccaaagaatgtgcaagtcttttgaaaactaatgccaacataaataaagctaacagctagagctctcagtttacccatccttctcacacctgccagtgagtcttttggatgtgagtggtgcacctccacatccactacgatataatactattgtccagtatatagtccatattcacattcactatttgcccaataaccttctttatggcaaatcccccacaccccgcatcagatctctcatcttatcattgaggaaagtctttcaagaagcttcccagatgactttcctgtatgtttcgttggtttaaaccaatcactggcaaaggagaatgggattttcaggattacttcagacctgtgggattcatcccatgggtctgggggaggggctcctaatcaggtgcttaggaaatcaggtgacca

SEQ ID NO: 106741 - DNA, 413 bp, Homo sapiens
aagctttaaaacaaaactcaaatgaacaatattaattgaatgtgatagatgaaactgaattatcatttgtaacatgagagtgaagtgggtagactcagattttttaaatttaatttttgaactaatagtacattcacatgattcaaaaataaaacgttattaaaaggtgtagagcctgggcgcggtggctcacacctgtaatcccagtactttgggaggctgaggcaggtggatcacctgaggtcaggagttcaagatgagcctggccaacatggagaaatccagtctctactaaaaatacaaaaaaatagttagccgggtgtggtggcgggcgcctgtaatctcagctactcaggaggctgaggcaggagaattgcttgaacctgggaggtggagattgcagtgagccaaaa

SEQ ID NO: 106742 - DNA, 493 bp, Homo sapiens
accccacttcaggtatgttctgaagacaagctagataatgtatgcaaagcactgtgaccttcttagagaaaggtgttcaatcaggactgtattaataatggctcattaccatgaacagttcatttgagctacagatttctgatcacatacaagatgtaaatgtcaaggaagacaaaaaaatgggtgggaggagtcattgtcataatactgtttcacttcctcaaaatcttccgactcccagaactttgggagatttcttgagaagttataataaaagagtagacattctagttcaaagttttaaagtataaggatggaaaaagaattctttccctgtaacagaaatggtttcaatgatttgacccagtatgactgctcgttattcacgtgtttctgtttttaccagacactatatgttagatgctgggaagaggaggatgagaaggggttctcaccatgattcgctcaggggtcctctagatcgaccacagct

SEQ ID NO: 106743 - DNA, 909 bp, Homo sapiens
cagctgaaagtaattacagatgtcaccacattcatttattcagtcacttatttatgcattcatataataaatacttattgagcatctattatgtgccaaacattgttctaggcacaggggatacagcagtgatcaaaacagacaaaaatccctactcgggaggctgaggcaggagaatcgctggaatctgggaggtggaggttgcagtgagcccagattgcaccactgcactccaacccaggcaactgtgcgagactctgtctcaaaaaaacaaaaacaaaaacaaaacaaaacaaaaaaaaaaaacaagacccagttaccaacctggccaaaattggagcttttaagtacactttagacctttgggaaaactgtgcttctggtcactgaaagcttaacagcttcccagttcttaaagactttttctgaagaagtcagaagtgatatcacaacattttcagtctttaatatggtgatacatatgtaccattcgactattttctaaatgactaatgcctgagttacaaaatcatgctggataaaagatcctttcaaaggagcaaaatagaccagtggactgggggttttcacctttccattctcaacatacctcttaattggtttcccaggagattgcggttagctaacacagttcctgtatacccaccccaggttttcccacacttaatatctctctttaccatggtcgttttcaaactaagactttctcggtccactattccataactcgctccaattccagtttcctaccgccctccggaaggtaaaattagagccaagcttggtctcatctccggcaggtcctgcattctggaaccagcgctggtgcaaaaaccggttcaagacgtgacgctgatcgaaaacacgatggccaaaaaagcgccagaa

SEQ ID NO: 106744 - DNA, 571 bp, Homo sapiens
gcaggccccaggtacattcccagcagctgcccatcctgtcaggggctgctggggcagaagtgacatggaatgcagaggtgcttccacggccagaggtgtgggtggttctgtccgtggttttggatgtgattattgtccagccaggtaatcgggagcttgtgaagcttcttgagcgaggcagtaatgtctgactatgaatacctgcagcttcagatttggaaaggacctttggaatagcagcagaagtcaagccctccaggaaataatgaagatgggaggccaggcgtggtggctcacacctgtaatcccagcacgttgggaggccgaggcgggcggatcacctgaggtcaggagttcgagaccagcctggccaacatgttgaaacccccatctctactaaaaatacaaaattagctgggcgtaatggcgcacacctgaaatcccagctactcgggaggctgaggcaggagaatcacttgaaccgggggggcagaggttgcagtgagctgagatcatgccattgcactccagcctgggcagcaggagtaaaactccatctcaaaaaaaaaaa

SEQ ID NO: 106745 - DNA, 356 bp, Homo sapiens
tactccctgatcttctttgcatatatgtaactataatgtcaaataaaaaataactgtgcaactgcctccttaagagtgcagggaagaactaggagggggtcagagtggggaagcatgatcattgcactctgtcttttcttctcagcagttgcagtgccattacaggagagctagggtcctgcacagaagacctacagaagtgaacaattcactgtagaatttgcaacccatctggcatatatcaaagattcagagacgataacataggtatatgataacataggtatggccattctaaatgcacttcgctctgaaatgcatagggggttgacaactgccactctctgcccatctac

SEQ ID NO: 106746 - DNA, 119 bp, Homo sapiens
aatcagtggccgtaaggggcgaggaatgggaacagggctgactgcaaccaggcagaaggaactttctagcagggatggaaatattatacaccagagtgtgatgatggctgcatgcctct

SEQ ID NO: 106747 - DNA, 655 bp, Homo sapiens
ctttgagaggtggaggcaggaggattgctttagcccaggagttcaagaccagcctgggcaacatagtgggaccctgtctccacaaaaaataaaaaactgctgactgtggtggtggtgcatgcctgtagtcccaactatttgggagactgaggttggggattacttgaacctgggaggttgaggctgcagtgagctgaggttgtgccagtgcacttcagcctgggtgactgagaccctgtctggaaaaaaacccgcaaaccaaatgagtaaaaattatactgaatttctgactattaccttacagtgtctagaatattataaaatatatgaaacatacaaagacctggaaaagggtgattgtataggcttatagatgacccaattattggaattaggagaaaagaacattaaggcaattggcaggataatatatgggggattgggtattttcaggtgagtaatggacatgccaaaaaaccaaatgcatattctggaactggaaaatagaatatcttaaattttaaaaattgatcaaatagccttaatagcagttctatgataagaaataaagacagaaggaaatggtaaatgtgtgaataaatatgaaagtttatcttctagtttttaaatttatatcgatgacagtggatagcac

SEQ ID NO: 106748 - DNA, 341 bp, Homo sapiens
gatcccctgcactctgcgatatctacattaccctgggcaaatcattttaatgctgatgagagttgaaagaaataatttgaaggctttgggaaaaggggaaataatttatacaagaggagactgagaagagctccagagcacaggtaaaaggaagccccttccatcaaggtggaggtccaggagagggtacaggcaggtgtgtgttgcagatatttttgtcagcgaggagaggggaagagggtagggatagttgaaagttctcttctgattgtctgctgagcataagggaggtggtgatcaagtagacttgaggaaggtgtagagaatagaatgaagcaatg

SEQ ID NO: 106749 - DNA, 368 bp, Homo sapiens
taaaaatatttgttgaaatatccccaaaaccagttatgtgatgacttaggttagggctggctggggaggggtcaggacaagacagaaaagacacagaggcaggacagggatttttgtgttgttatacaagtttttgcttttgaacatataaatgtgttatgcactcaaaaattatgtaaatacaaaaataatgcagtctattagtcttttctgttatggaagtttcctataataaaacgttttcctgcattttttcctaagcaacttctaagaacacgttatggagcttttaacacaaattccagcacttacatcaagctcacaggcaaggcctcactacgaatctaagcctggggatcagttagagc

SEQ ID NO: 106750 - DNA, 605 bp, Homo sapiens
gtagtaacatcaaagctattgccagcaattgccactgatgtgagtctctctcaagtgttaagaacaggacacccagagaaaggcaattttgaaagagtaggtgacgacgggcaatacaattaattgggccctttatgtatgagctgactgcacatgaagagaagacataaagaagaagacgggaatgagtacaaataatgagggataagtcaggagaaatgccatagacaacaattttctacttgttaatttttcccaggcttcattctgcaaagaaaacaagagaaaagttggctctaatatttcatctcattttagcagcagggaaatggctaacctttcgtatgtcctttgtcccagagccaaactccattttctccttcatgcttcctaatgtattttgttctattacggagccaaatacattcattgtaattaaacatggactttgagagctagaagtgttttaagagttcaaagataaaaccatcttttgatggtctgtgccaaataagcacaaaccctgatttctgaaaatccatgatttctcaaccttaacaatactgacatttggagctgggtttttgttgttgtggggggggctg

SEQ ID NO: 106751 - DNA, 269 bp, Homo sapiens
aagaaagagatgtgggggtttggtgaaactcaccagaggctggaccctctccagcataacacagggattgggaggagcggggcggcattaggccaggtgcatagcccagtgctgctatctctggactttctgctctctctggacttgtttactagctgagcttatccatttacataattttcagtgccatttctcagctgatgagtcctgaacttttgtcctgaggctagaattctccttgaaacagcagtcttaaacactcaacttct

SEQ ID NO: 106752 - DNA, 375 bp, Homo sapiens
tgtatcttcccttgttccagcccctttgaccctgcttatagcacatgggttttcctccttggaattcttcagaaactatgagggagtcaggtaagggaacaggattcacagcccaacctggtattcacccagctcatctaccaaatttggtttcaaatgatgtgtgactggctgttgtcagaaatcaaataaaaggatgaagatttgctgccaccaaggaaattccaggagagaaactcccccagtgttgcgaacatcattaataactgccagctagaccagcagccattcagaagagtggcttcagctagcatcccaattgccagggaagaaaacacaggacctctgtggtgccaaacagacctgggtccctgc

SEQ ID NO: 106753 - DNA, 688 bp, Homo sapiens
tggtagctagaatatcttatattataacactgaagtaatcagagttgctggagaggggatagattggagcaggggaggacaatgtatagaataatgtctgaagcgataatggccaaaaattcctaaatttagtgaaaacagtagatctgtgtgatctaatgatctcaacaaatccccaagtacaaggaacatgaagaaaactgcaccatgtcacattacaatcaagttgattaaattcagtgataaagagaaaatattagaagaagccagagggaagaacacactacaggggaacatacagaggagttactcatggagaataagaatgacagcagatttcttattgtaagcaatgcaaactggtacttaacggagtaacatctttaaataatgaaagaaatgcactgtcaacttagagttctctacccagcaaaaatatctttcatgaatgaaagtgaaataaatacttttctagatatacaaaatctgaaagacttcattgccatccaacttaacctatgagaaatgttaaaagaattcccttaagttgtggcaaataacagattaatgtagacgttaaatagattagaaccatgtttattgtggaacagaagttgtgagagcagacattcgtattttttccttatctttagggaaaaagcattcagtctttcatcactaagtgtgg

SEQ ID NO: 106754 - DNA, 259 bp, Homo sapiens
ggggagcatatataagctaggcttgaaggataacgataatagctaacacgtggtcatagcagttccagcctctgtactaagcatcatgcatacattatttatattaatcttcagaaatagatactatcccccagtttacacctgaggaacctgaagtttagtgagattaagtatttgcccaagttatatagatatgacatcaatttagtgttgtagtatgtcattattgtggctaggaaggaataaggccagtatttgg

SEQ ID NO: 106755 - DNA, 384 bp, Homo sapiens
tgttttgttttaaatagagatggggtttcacaatgttgcccaggctggtcttgaactcctgggctcaagtgattctcccacgtcagtctcccagagttttgggattacaggcatgagccactgcttccagctgagggctgcatttaagaatgtatcaaggggtcctgaaaccaaaatgagggacattgctctatcacttactgtgttaatcacatttctcgtaagtgaagtggttttattttctttgttgccctattatgaatttcattcctaagaaaactctgcaagggatgtagggatttttacagataggggaatgaagctcagagcggatacctgatttttttttctttttgagttggagtctctattgcccaggctgga

SEQ ID NO: 106756 - DNA, 703 bp, Homo sapiens
cgagatacttgtcttatttttcctactgggtgtacagtgtctgaagactgagtctgtcagttgttcttgtttgcgcagtgccctgtacatagcacctccacagaaagcatgtttgtttgcgagtcagctgaattgttgaatgggtttttctttgcctcctgggttatattgtaaaccccctgtggtcaggaattgtggcgtgtacactttcatgcagccgagatgaatggcgtagagtccaggctgatgcattttattgatcaaaagaccagtaaatgatcatatagttttttctcctttcagttacaaaataaatcagcagcagggcattttactgacagtcttccttaaactgtttctcccccatcaccaagtgtacagggcgacgggaggaggtgtgtggtgtgattgggcccccagtggctggactctgcaactgaccttgcagactatggcaggtgtggaggaaggagcagttcagatgcagcccctttgggtggagctcacctttgctggcactgtgagttttcaaccaaaacacattgacaacatctcttatgggcctgaccctgttccagtcccgggaatactgcagtgaagaaaacacacacgactcctgactcccagggaacttgtgttggtggagtattgtcctgggatcttcagtcctgggccacgaggaggcagtcagccagagctagcc

SEQ ID NO: 106757 - DNA, 668 bp, Homo sapiens
agtctatgcagattttaagggaaaaaaaaaattttttttcaccttcaaatatttgagtacctgtttaatgccaagcctggaacacaaattataagatgttggtttaaatttaagctattgtgacttcatttagaataattactatttgagattatggaatcatattccttagaaattttttaaaattaccacctgtacctaaatttctcccccaaaatactttttttttttccagattcaaatgtcataggcatttacctgcacctgttttggaatctatcttgatacatgaaattgaagtgcttcagctcgtctttaagtcagtagtggtttattaaacggttatatcacatctggaaaacattattcaaaacatttattcagcctacttcctgttcatattttagaagatgtaaagcaatgaaatttgctctaaataaatggcatttttttggccattatttggcatcttgccgggttactttttacatccaagttgaagtgatattttgttctcaaaataaaataattttcaaggtttggaaatataatgcaaaaattttaacagggattcttatcccaaaggatctgaggggcctgatttttttttttttaccttttatgtatgtttgtgtgcatgtgtgtgtgtcatttgtaccctttgtaag

SEQ ID NO: 106758 - DNA, 221 bp, Homo sapiens
tccatactctaatatggccactttgcaggtgaggaaactgaggatcagagtgaaagcaacctgcctcagcccccatagataataacgatcagagccaatataaactggtgtagtaagtaagaagacaaagtaggtagtattgctataggtaaagcaagagctaaggaaagccttagttgatatggcagaaataggaacagagagaaagggacagaaaagga

SEQ ID NO: 106759 - DNA, 797 bp, Homo sapiens
aatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaacc

SEQ ID NO: 106760 - DNA, 533 bp, Homo sapiens
cttagtatatatcttaagtaatacagaaataaggacctggaagtaaaaatccaaaacaagtggcactggcttaacagactggcagtgagtaacaaggaaacagattctaacatatggagagccaataacctttgtgatagtatatcaaaatatttgataaaacttgcaggcaaaccatgtgtcacagtgcttgtagcacacaagaaagcaggtataaaaggggagagtagggctgggcgtggtggcttacatctgtaatcccaacattttgggaggctgctgtgggcagaccacctgaggttggaagttcgagaccagcctgactaacatggagaaacgccatccttactaaaaatacaaaattagctgggtgtggtggcgcatgcctgtaatctcaactactcgggaggctccctctgcccgtgtcctgtaattcaactgactaaaagttcagaaacgtggagctatgcaagatgggaaagacaatcttctttcccaaaccgcaggagggacaggcattgatagcccttctc

SEQ ID NO: 106761 - DNA, 161 bp, Homo sapiens
gagattaaagagatggtacacgagcagaaagctcctccccaatctctgtcattccctctccaaccaaatccacctgccgtcccagactcaaatgctcagccacctaactgcctgaggacccagcagttaatgagtttacatgctgggggcaggagtcaggg

SEQ ID NO: 106762 - DNA, 316 bp, Homo sapiens
ggtgaagatgaggacagtgtgatgcaagcagatgaagtcgcttttttctgaagtcgcttttttctgggctcctttcagtgctaggcaggcctgaggccctagctcaggccaggtgactcacaccaacacttcccaccccgtatactggtcggaggagccacttactagacataactcagttccagagatgccagtgttttatttcaataccagcagagagcaggggcctttctattcatccacaggcggattctcccagaagggacgctccaggtgccagggtcaggtcagtgcctggctcttggaagtttccata

SEQ ID NO: 106763 - DNA, 804 bp, Homo sapiens
agtaagtatccaagtgatcgatactggcatgatgggggtaggggagtgtcaggtaatgcaataacatacaaagcagggatcactccatttagaatgggttgtcactcccaggaatggcttccaagctattaggacccagagataaccctggacttggcaactaggtagagagaaggggtattcacctatgtaagtgaccttaggcaagtccttgctcgaaatctctcctcctttctgccaccaatccactcttaccccttagtttcttcttcctaagtgttgcactcccactcttcttttaaagtgcacatgccccgaggaattaaagctctgaacagtctttgagaacgctgagcacatcagttccttcctgagagaggagggttacaaggttccttggttacaaggctaatgctctgctgtgaccctggttttcctctaacccaggtcaggacagggatgtgatgtgactgacactttttaccccacacatggcctctggtgactgaaggttgacactttcaccagccctccccccagggtgccccgtcatctctcctccaaagctgacagcacattggcattgctgacaaatgactcatttccagccacataaaatggcttcaatcttcttttttgaagtctcacagattacctcctccgcctcctgcttttctgacaacttcgctccagcagtgcattatgttaaaaaccacacttattatgccagagtgggtctggcacgattagagttcagtttttataacagatgtggatatgcctgtaatgacctgcttggctcaa

SEQ ID NO: 106764 - DNA, 629 bp, Homo sapiens
ggtcagcagaggaggtactaagaaggaccagtcaggatttattggagtaaatcgcaggggtttaccgagggactggatgtgcgctgggagagaggaggcaaggacaccctcattgttttctcatccaaaccaagatttctaagcctgaacaatcggatcaaaaatggcattatttactgtgataggggaacccaaggtgagttaccaggcagagagtgaaggggagaaccaagagttctggttcaggtgcataatgtcctaaagaggggctggaaacatgcatttgagaaggaccagtgtttagctagctggcttagtgccacgggactaggctgcctgttcccaaatggcaattcaggagacagaagagcccaaaacagaaggctgagatgaaaccctttacagagcacgtacacttgatgctgtaaaattactcatgggagtactgcgtgacttcagatataatttaaattttagaggttgtggctttttgtgtgtgtgtgtgagacagggtctcaccatgttgcctaggctggacttgaactcctgggttcaagtgatcctcccacctcagccaccagagtagctggaactacaggcacatgccacggtgcttggcaaaattttag

SEQ ID NO: 106765 - DNA, 403 bp, Homo sapiens
agttctggtccccactgactatctctctatgttcatagatacttagtgataacccagtttctgaagtgggtaggggatatgtttatggaacgggtgagtacatttgtcttgttctctcctggcatctgttagaagatggagttggctatagaacagtgagaagccacggaagacagtagaggcttggactagaatgtgctagaggtagaggtagtgaaaggtaggtaaagatgacctgcctgctccattctctctgccattcctctgtgccaccagccccaacactaaggggactattccagttatttaaaaactgaggggtaaatatcgaaacactgaatcataatgctaggggtattgtgtacagccgtgccttgtacaagggtggctggccaagcaagta

SEQ ID NO: 106766 - DNA, 360 bp, Homo sapiens
cttaactggtgtgtttgattatgatagataaaaaagggaaaaaattatagaaatcatgtggatgttagcaagaatatgcatagtggttttagataatgaaattttattggaaaattgcataataagaaattaataccatataatgcaaactctagttttctgcgaatgagatagggtgatttaattgtaagtagagaaactatctaatataaaacaatacagtgtctctctggatggtaatagcaatgtgctaccagttcagagcaaaaataagaaaaatataatcaaaacttagttctggtaatttctcaagagtgagatctaatataatttcatctatttcccagtacttccagagtt

SEQ ID NO: 106767 - DNA, 436 bp, Homo sapiens
cccaggagctgaggggggccaaacaggtgggccaggtagtctctacccataaggccagggcaccaaggagacagagagaattcctgctggtgttttgacatcacggatgtccaacacccacaggctcactggcagagaccaccatcccttctccactctagggccacccctccaagtggggtactcctgcagcttgactccagctctgaggagcaaactcactctgtgacagctcagcaggggcaacagagagaaccaccaaaccagctgctgccaccagaccccagcacagccgggacccaggacgcactaaaccagccgccgctactagactccagcacagttgggacccaggacacactaaaccagctgtcgctaccagactccagcaaagttaggacccaggacacactaaaccagccgctgctaacagacc

SEQ ID NO: 106768 - DNA, 321 bp, Homo sapiens
ggtgtttgaggctgccatgagctatgactgtgccactgcgctccagcctgtgtgacagtcagactctgtctctgaaaaacaaaagaatgttcattgaatttgacttcgaaagaactgaacaattagaaacaatctaaatgaccaacaagaaggttgattatgatatctgaataacaggacttcaagaagggattaaaaatcacaccaatctgtatttactggcatagcaaggtacctatcaacagtatgttaagtgacagcaaaaaaggttatcagacagtacatacagcatgatcctctactgtaaaagagggctgtgtg

SEQ ID NO: 106769 - DNA, 563 bp, Homo sapiens
ctccttttttctgtatcccattcaccagttgtttgactctaaagattgcttaacttacctgcatctctatttccagttctgtatcatagaatggttgatatataattacatactttattttgactatccaataatagcaacagctaatattgagcatttgctatctacttatcactgttctaaacactttgcctatatcatcttttttcaatactcgcacaaatcacatagtataggcataccccatttttcagagaaggctattgagacacgaaacagctaagtagcttaccaaagtttaccagctaatcatgctaacctgagattcaagccaaagtagtttggctgcagagtcagcattctcaattcccagcactataatttatttcttcattcaacaaatatctattgagcaccaggtcatgctattgaccctagaagtatagcaataaatagacagacattcttgccttcatggaatttatattctaatgcgagagacaggcactatgtaaataaacatgggctttgttgtaggtaataagtgacatggagaaaaataa

SEQ ID NO: 106770 - DNA, 367 bp, Homo sapiens
attttctgaaaggaagagaagctctgaaattcagtgaaaatgacagggcggttgctattgtacacattattagaaagaaccatttcaaataacaattgtaaacatgtattttaatgctaatatactgtaatagcctagcattgagtagtgaaacaatttcagacaagtgtccaaattgttttatgactacatttatttcttagtatttatttagaaaattagtagtcaatgcttagttttatcccagtatggattataacttgtataatattctatagaaaaatgttacctaactggaataactcagagctgcctccctctgccccagcagttggtttgtgccctatgtttgctgattaccttaaat

SEQ ID NO: 106771 - DNA, 219 bp, Homo sapiens
attcaggtacacatatcctggtccacataagcacacatttctttgaagagactgtgtttgcccagtatcctcctttgtcataaatcaagcctctatgtatgtatggttatgtttctaggctctctgttatgttctactgtgctgttgtctgtcctagtgtcaatatcatacacttaattactgagctttgtaggacattccatacatagtacctgtgga

SEQ ID NO: 106772 - DNA, 434 bp, Homo sapiens
gcaggggcagagcctgtagcagcctcacaagagaagtaggtagagctgtcccagcgtgggcaggcgcctgtgctgcctgacacaggtaatgaaggcagctctgcatcctgacactggccctgccacctccgtgggtgaccagcacacatccacctagcagtcccagctccctctgtaccaggagcccctgaagtcagctgactttgcttgcaaaatgttctagagcctcctaccagtctgggtgcacccccctccactccaccacctcagcagcttggatgtctgcggggaagccctcctgctctctctctcccctgccactgctgattttgctcaagagctgtattattcagcacttaggagggagcagacactgatctaggcttcctcccaacggggctggcagctccagaatacttgagcacagctccccg

SEQ ID NO: 106773 - DNA, 1000 bp, Homo sapiens
atttttcagtatcctcacttgttcttaaggttgtttgacccagtttatatcctttttttcccccttaagtagacatgaattgttggtagaagatttctttatagatgactttattatttttatttttaaattttttacagagatggaaacttgctaggttgcccaggctggccttgaactcctggcttcaagccagtcttttgcctcagcctctcaaagtgttgggattacaggtgtaagtcaccacagccggtttccagctgactttaataacataaccagtctcctaacactcttaatatagttctgtctgacctttgatgtctaattgcttcatctggaattgtgagacagtggtactgaaggagagttatgctcttaaactagtagtacaccaactggaaatcatttaggacagggtatgtagagtcagcctagctacatcagtttcagagaggtctactttgggggtttttaatatttgcattttattataaaaggactacatagtcattgtaaatattaaaacaaggtagaagaaataataaagtgaaaagtaaaatttccttctttccaatgtctgtctactactctaattccaaagaaatagctactaatattgatacctttctggaagttttacatttataaagaaacatattgtgtgcatgcatttatgtctaatacattttggatatataatacatacatttggctgggtgcagtggctcacgcctgtaatcccagcactttgggaggccgaggcggacggatcacgaggtcaggagattgagaccatcctggctaacatggtgaaaccctgtctctactaaaaatacaaaaaaaaattagctgggcatggtggcacgcgcctgtagtcccagctacttgggaggctgaggcaggagaatggcatgaacctgggaggtggggcttgcagtgagctgagatcacgccactgcactccagcctgggcgacagagtgagactctgtctcaaa

SEQ ID NO: 106774 - DNA, 339 bp, Homo sapiens
caaatcttccacaccacccgctgcgctgctgtgtcccttctcctccttccctccatgcccctcagtttcttctgtcgactttcaaaagaagcctctaaaacggaagagccagctgagattttggaatacgcgtggtactgtctgcctgatgactaaaaagagccctacagtaagagggacggagcctaaactggctcacggaatcgcaagcccggctacctggttagaatagaggctagaattgtttccatttctgtgccctaaaactaaggaaacaagttgtactttggttttgtttatttgttgggattttaaaaagtatcttccttgtccctcaca

SEQ ID NO: 106775 - DNA, 361 bp, Homo sapiens
attgctgccaactgagttcaaatagagggaatggccccagccaagatgaagaaagacttcaaaaagccaatttatagaggcttaaatcctaagagatttgcctctgctttcttttgaaagtggtggtccccctcaaattctcctataatttatttgccttatagaaatttatttaaacactggttcagctggtgcaggctatggggcaggagtcacctttaaagataatctacaaaaaaaaggagggagatcatagttacaaggagcaggtataatgctaacttttattcagcattttctctgacttagatcacaagaaaacttggcagtgagtaacatgtcaaaacctaaaagaaagtca

SEQ ID NO: 106776 - DNA, 372 bp, Homo sapiens
tgggaaaattgagtaatcatgtattaaaaagcaaaataaaacaaaacttgaccactgcctcacaacatacacaaaaatacactcctggtagggccgggtgcggtggctcacgcctgtaatcccagcactttgggaggccgaggcgggcagatcacgaggtcaggagatcgagaccatcctggctaacatggtgaaaccccgtctctactaaaaatacaaaaaattagccaggcgcggtggcgggcgcctgtagtcccagctgctcaggaggctgaggcaggagaatggtgtgaaccccggaggcagagcttgcagtgagccgagattgtgccactgcactccagcctgggcaacagagcgagactccgtctc

SEQ ID NO: 106777 - DNA, 517 bp, Homo sapiens
cctccccatctcgtcgacttttttaacttaaagtcaactgattataggctttaaggttccccacttctatctaggacatggtcttcacaaggatcatctggctgagagttaagagaattaaactgggaatgcattgatggggcaaatttgcatgtgctttacatatcatttgctcacactgctgtaaacctgacagcatattctctgccacattttcatggttgccctgaaggatctgcttttccatttttctcttctctgacccattatgactgcgaaggtcaatgaccaacagcatcactgactgcagagagggccagagaagggaagcaccagcaggctgcgaggacctgctcccagccccctgcccactggggccactgcacgaggaagacagggcacccactcttctacctgctgacctgacttttatttagttccttgggacttcctactgctttgtcctggacacagtgacaggtgccaggatatggggactggttggcatcagtcctga

SEQ ID NO: 106778 - DNA, 330 bp, Homo sapiens
aatccttccgtcgacctttgagctaattttttttctgcagtcagaggagaatcatatcatcatatctcatattttattccagcattattgagaggataaagaaatgtctgtgaactgctttgaactttagaataagtatccaaataaaatgtacaaacaataaaaataagagaacatgtcattacagaaacagttcagtggcttccatcaaaacatctatcaacatttcaagtctccgatttcaagtctaattctctgttgataaaactggaaaatccacttctttcattctgttttgatgtcgacgcggccgcgaatttagtagtagta

SEQ ID NO: 106779 - DNA, 193 bp, Homo sapiens
gggattacaggtgtgagccaccacaccggcccattctttcttttatactgagtattcagaaatttttttaaatgtgttttccacttacagcatttctcaggttggactagccatctttcaagtgttcagcagccttgttggacagcacagctctggagggtgattttatgtacattcccactgctctctctgc

SEQ ID NO: 106780 - DNA, 422 bp, Homo sapiens
tttttttttttgagatggagtctcgctcttgtcgcccaggctggagtgcagtggcagaatttcggctcactgcaacctctgcctcctggattcaagtgattctcctgcctcagcctcctgagtagttgggactacaggcatgtgccaccacgcccagctaattattttgtatttttagtagagatggggtttcaccatgttagccaggatggtctcgatctcctgaccttgcgatctgcctgcctctgcctcccaaagtgctgggattacaggcatgggccactgtgcccggccctatgctaccttatttctaaccaaaattttcatgatataggatgccaaagaatacatttctagcttcctttgtcatgattctttcagtcataagctaaaaggagcttataagaaaaaataattccgtt

SEQ ID NO: 106781 - DNA, 455 bp, Homo sapiens
tttttaaggctagtcaagtgaagcaacaggaatgtagaagaacaaataaatctgtaagtagctgtgatcaattagttgtaaacagcaccgcacttggaccagcctgtggtcacccttaacatctatccaaaagctgatgaaagcagcagcctgaaggcatcacgtggtacaagaggagcaggtaggcctgaaagagcaccccaccccaacttcccctttctttcttattctctactatttctcacatttctttctactgcctcactggttcttacacaggattggttccctatctagagggtgatgttaagtttaatggcatctgaggaacttattgtttaagcatgaatgtaacactgtaccaggtggctgtacagccctcaagccctacctacccaactctagtggggaaacctaggaattctccactaaccaatgtgaacaaggatgtgggc

SEQ ID NO: 106782 - DNA, 610 bp, Homo sapiens
ttggagagagggtctttgcagatgtaattaattaaggccaacaagatggaacttaggatagcccttaagtccagtgactgacatccttataagaaggggagaggacacagccacagaggggcagccacgtgaagacagagccagagatgggggtgatgcagccaccaggaacaccagggttgccggcagcccctgaagctggaggaggcctggaatggattctccttcagtctccggaaggaaccaacccagccaacgcatcagttttggacctctggcctccagaactgcaggaagaaatttgctaatttgagccactcggctcatgggactttgttttggcagccgcaggacactcatgcactgtccttggagtgtaagtttttattttaaacatgtggctccatttgccagaatctccccaacagaccccaaacccaatccagggtctaggcagggtagcagctttgacaggagcctgtcggtgctggtggctcctccatgccccagacaccttgccttcccccgccccgtcctctccagttctgtgtataacacattcctgacaagccacacacaatggggcaaaacattttggagatctataaaa

SEQ ID NO: 106783 - DNA, 300 bp, Homo sapiens
agtagagatggggtttcaccatgttggccaggctggtcttgaactcctgacctcaggcgatctgcctacctctgcctctcaaagtgctgggattacaggtgtgagccatcgcgcccggccaacagtgatcactttcaaactaacagaggttcaaaaataaaatcagacttaaccaaaaaccaggtaacagagctggtaggatatacagaaagactgacctcacgtatatcaacgattacagttaatattaatgaaggaaatgctctagtttaaaaacgagggttgtcaaagaccccacat

SEQ ID NO: 106784 - DNA, 276 bp, Homo sapiens
gttatgggatggacgaatgtcagggtgcaggcaaaaaaagggattggattgaggctaaaggagacatagaataaaatattccatgaagaaaggcatagtgagaatccaaagcaagcaaactattccttataaaataattgaatgggttttcacttctagtagtaggactatcttatcccattcagtgtttctttcctgttttctttttgttaggtagttaaacctctgagatttgatctctgagaggtaataccgtagatctgtgttatgattggt

SEQ ID NO: 106785 - DNA, 353 bp, Homo sapiens
atctggtgagggccttcttgctggtggggactctgcagtcctgaggcagtgcggggcatcacatggccggggctgagtgtgctaacatgcttgctcaggacgctcttcctctacgtataaagccctacttccactcctgttacataacccatgaattccttaacccactaattcatgaacggattaatccattaatgagggcagagccttcatgatccaatcacctcttaaaggccctgccacattggggataaagtttccaacatatggaatttggggaacacacattgaaaccatagcacattccatctacaattttctctttgccatgtaacctaacatatttacaggtt

SEQ ID NO: 106786 - DNA, 497 bp, Homo sapiens
attctctccacacccccacaaatctagcaggtcccacactgacttagtccacctcctttacctagatatccaatccatcatccctgccactgccttcgacgagacccctgctctctctcagaaccccgtccatggccccttaaatgtttccatcacctccatcctgtgtgtgtgtgtgtgtgtgtttgtgtgtgtgtgtgtgtgtgtgtgtgtattctatactctgccatatggaagcatctgtcattctcaaatgtgataatatgatgtgctctttcaaagcctggtccatgaacaaacattggcccctcatttggagtatcttcacatttctattcctagcggcaacgactgtgcctggcacatggcaggggcactgtaaatgttgacgaatgctaactggtgctgcccggcaaaatagaacacatggtaccatttgacttattttctgaaatgtatggagatgaatggaaaaaataaagatctgtccaggaaaa

SEQ ID NO: 106787 - DNA, 175 bp, Homo sapiens
tcaggacggtaagtcttcttctaaagttacatgaaagttgttttttaatgtttcatttgtgcaatgtattactttcaccattacatgaaaaacagaattgaaaaagacactgattaccacacatagcctttaagctgaaggaagaattttcatgctatgtgtatcatacctgtgg

SEQ ID NO: 106788 - DNA, 410 bp, Homo sapiens
taggagattgtgacaaaagcgagaaagattgtacacaaggatatttatcctgaattcaaaaaggaaaaagtaaaatatttgagtaagtcttgatatatccttataatatacagccattaagatgatcagaggtctgtaatgactagagaagacattattcatgagaaaactaggttagacccttcctgggattatccaattaatagaagtatgtccacctaatgatgtgattatatgcatagaaataatagaaggatattaatatgctaacaattgtttactgtggcatggaaggttgggatgatattttaacttttcaaaaaattacagtgacatcaattttaccaaagtaaaagtgaaacaaagttatgcataaatgaaaatcccttatagctaaatcttgtttgttt

SEQ ID NO: 106789 - DNA, 423 bp, Homo sapiens
cacaccaacacggcacatgtatacatatgtaacaaacctgcacattgtgcacatgtaccctagaatttaaagtataatttaaaaaaaaaagaaaaagaaaaagacctttactcctaggagcagagtcaggaaacagtttatagtccaggctcctataccagtacactgaagatttgctaccactggggaaggagcagaaaatctctcctgcacaaaacctatcaaagaaatggggccgggtgcagggctcaggcttgtaatcccagcactttgggaggccaaggtgggaggatcacctgaggtcaggagttcgagaccagcctggccaacatggtgaaaccctgtctctactaaaaacacaaaattagccgggtttggtggcacatggctgtaatcccagctgcttgggaggctgaggcagaa

SEQ ID NO: 106790 - DNA, 430 bp, Homo sapiens
ccccagctcatgctcttctctgtgccccctcccataaatacctgcccctacatctataaataatgccacctgtttgctgtcaccagaaaatgtggggcttgttctagaacttcacataagtggggccagacagtaggaacccgtctgtgtctggggaacactgaggtagacccccgttgtccaccatggccctagtccctgccttggcgcagtgactgatcccctgttggtcccacccaccctcctccctgcaggaacgggttctgggtggtttcggcctgggcgtttttcacattttacagactggacgtcaccgccttgcacttttctcccaaggaggcctcgctgagatttctcggagcaggcacttgggcctccctcgccggcgtcttccgggaggccactccctgctggacccagggacgccccg

SEQ ID NO: 106791 - DNA, 432 bp, Homo sapiens
gagggtggggggatttatgctatctccctaacatgttaattctgcaagaagtgtatcccctcttatggatttctgccccatggcgttttgcatagtgctgggcatttagtaacactcgggctgagtagctttgaaaccatcaaatgtactttatagagaaggagcttggtgttgggggaggaagccagagataaagagtaccgtcctgcttacctgcttccagacttccacagaatgcccactctgctctgttccctagaatgtgttaattcatccactcattcaacacataggtctagagtgcttgctgtttgccagatatgatatttgctgctgggcatcagcagtgaacgacagatgctgtgtcctatgtgccgtgcttgatggatgacccatcacagtcacattactgatagcaggggcatggttaat

SEQ ID NO: 106792 - DNA, 590 bp, Homo sapiens
agccctgctctctgcaggcaagaggaagggactgagcctttcatgcccagttcttcctactaaactcaccaatcaaaggcacgagaacaagagggaggccctaggtttcccttcacatgaagaaaacaatggagagtgagtagtctgcagttatatctctaatgcctttgcatttggagtaaagcatgaactccttacttgaggtcactgggattgtctacttctccatcttcatcttttctaacttcctctcactccctaagcggcacacacactggccttctttctttgtttctcaagtatgccacattagtccctaaaggccttttaactttcttttccttctttaaggaccattctgccctcaggactaattatttttcattattcacatttgtgctcaaatgtcaccacagcgtaataacatgatcacccaatttcaaagaaatctttcagtcatttatcatcttattttattagattcactgaactaatcattatctgaaattgtattgtttatctgtttgtttgcatgtatattatttgcttccttccaactctcaaatatcgacttcatggaatcacgatta

SEQ ID NO: 106793 - DNA, 304 bp, Homo sapiens
ctgatcttgtccctgttgagaactgtggagactgtgccaagctgtggaccatgggattaggttaggtaactaaagaaaatatccaggctgtgagcacttttcaaacctaagaaaatctttagtttcttttgcacagttgtaaaccgtttgtgcttaaaaaattataaaagtgattgcagttgagatagagaaaagagcagtgctgatatgtgtttatatacttctaagggctgacttcatttttttcaacatcttaaacttctattgaacaaatattgtgtgtgtaggtgtgtgtttgtgtgtg

SEQ ID NO: 106794 - DNA, 906 bp, Homo sapiens
cattttgtatggaactgtctcacatattgtactcctggctcccactcacaaaatgccagtagtgctcccagatcattgtgacaatcagaaaagcccctaaacgttccaaaacatcctgaacaggcagtactgccgctattgagaaccactgatgtgtaggatttggagttggcacagactgctaatttgtggtttcaaggtcaagctcaaggctttgtgcctttgagcacagcaatgggcacacttgaaagtgagtcctttgagggttttttgttttgtgttacagttcagtgaggggtcaaaagatgaaaaatacaaagaaaacgggatttgtgtattttaaaagctaatttgcatacaaatatgtgtttgtatttatttctggtgaagtcttgaagtctgccaacatttttttcaaaagttagacgtcatgtcttagaaatggttttcactttgtaagcatttgtatgggaatacaaaatatcattttttggcaacacctatatttgtaggaccataacccttcataattaaatgtgagtaatctaccttttccttctacagagtcaggtctcaggttgactcctctgatcctcctctgcttagtcctttcggggcactgatttcaggatgacaccagggcgatggagtgtcccatcaatcccagtgtgttctctaatggaaaatgtgcttttctaattcaaaccagatttggctggtctcaaagagtaaaatctttaatataaagttgggttgtgtttttaagctaaaaaacaaaaacaggctgggcacagtggctcacgccttaatttcagcactttgggaggccaatgtgagaggatgactttgaggccaggagtttgagatcagcctgggcaacaaagtgagaccccatctctattttta

SEQ ID NO: 106795 - DNA, 320 bp, Homo sapiens
gctctcctgatggctagcagtgtcaaggatgcctgctttctacccaatgatgccggcagagagggagggaagagccctgggggcaacggctcctctcccctcgacagtggtgccatggatgggtggctaccccagtcaagggtccggccagagtggagacttctgcccacaaggtctctgctgctggtttgccaaagaagaaaacaagccaggtgactagacactgcccgtggccagacaggggagcccctctccccagctctccctgccgagcgctttcgcggactctggtggaggtatgtctactccctgacccctct

SEQ ID NO: 106796 - DNA, 371 bp, Homo sapiens
  misc_feature (311)..(311): n is a, c, g, or t
  misc_feature (319)..(319): n is a, c, g, or t
cagaagccaaaaaggtcttaaaattggaaatagatgtctttattgtacttcagccaacagcaagccaggggaaggaacatacataaatatgacaggtcatatatgaaatttggctctcctcctatcaaagtagcctaggagcttggaggaagcctaattaactaaaacaggaaaaaagcatactcatctgatgtaaaaactcatcagctgtaaattaccaacattaaaccagaagtcattaccagttaaaatgtgtggttttcatcttattcttaaataggagaggtggacagtagtgtaagtaacattgntttttaanggccattaaagcttttcccctggggtaaaacatggggtcttaaaattggggg

SEQ ID NO: 106797 - DNA, 760 bp, Homo sapiens
gaagaagccccagttgttggttcaaagttgatagagactttgctccctagatcacctattttagcgtcaggcaggacagcttagtagtcaagagctctggagtcagactgtctgggtttgaattttggccttgttcagtattaactgtgggatcttgagaaagttacttaaccttttgatgttcagtttcctcatctgtaaagtgtggataatatacttaccttatatagggttgtttcgataagtaaatgaaataatctttaaaaagcaattcgcatagttactaaaataatgtaagagttcaaaaaatgatgaagtgcttattttattattgaatatgtcatctatatgttgtcagcttggactaaagaggaaagaattgtgtgaggcatgggcattgaacaatggtaaagtagtatttcctgatgagtgtttactcaggaaaagggtggtactgacttaataggcttttagccctatatccacttctgctattcttatctcagatgtatttgtttatattgaatgtatatcaagaaatgtattacaggccaggtgcagtggctcaggcctgtaatcctagcacttagggagtccaaggcgggtggattacctgaggtcaggagttcgagaccaacctggccatcatggagaaaccctatctgtactaaaaatgtaaacattagcaggacatggtggcacatgcccgtaatcccagttactcaggagactgaggcaggagaatctcttgattctccac

SEQ ID NO: 106798 - DNA, 5466 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106799 - DNA, 5359 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgagagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106800 - DNA, 5191 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagccagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106801 - DNA, 5122 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106802 - DNA, 5362 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcacttttttttttttttcttcttatgaataaagaatgccatttcaaaaacaaa

SEQ ID NO: 106803 - DNA, 3176 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccatgcgcactaccatgatatctctgccattatcagagcttccactccgttata

SEQ ID NO: 106804 - DNA, 704 bp, Homo sapiens
tactctagaggatctttgtcagctctctcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106805 - DNA, 1438 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagtcctacgagagggagaagaccagcttcggccccgcgctggaggagacccagtgggaggtgaggccacacagggctcatgggtttgggtggtcagcggtttggcgccagtacccccctctccttctggtgccggccaatagcgtgcaaacacagaccgcgcaggcaagcggggctaatgtgctggctttatcacccaaagaaggggctccctgcaaaccatgttgggggatcgacttacatctgagcttcctcctgtccccaccatcaccctcatggctcctagatttcagtttcccaagtgagccattaaatcatgaagccggaagccagatgaccaaggcccagccaggctgtgggctgacctcccttccat

SEQ ID NO: 106806 - DNA, 5397 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106807 - DNA, 5290 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgagagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106808 - DNA, 4307 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacacgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106809 - DNA, 4078 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccaaaaaaaaaaac

SEQ ID NO: 106810 - DNA, 4835 bp, Homo sapiens
tgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatgggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagaacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccagtcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtcccagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgcctcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggaacccacccatccgcaataacttaacaaggatctgaatcatgccctctggccgactgactgtcacagggttc

SEQ ID NO: 106811 - DNA, 404 bp, Homo sapiens
tggtggtttgctgcacctattgacctgtcttctaagttccctcagccaattgatttcaatgagtctatcaatgccaaaatttgacaaagatatggaccaataggttctcacacctactgctgagattatagtttggtacaattatgttggaaaactgtttacattatctaataaagttgaagatgacacattctacaacccagtgattctcctcttaagtatatttcaaaaaaatgtctagcaagagattgtttttgcaaatagagacctgaaaaaatgctcaggagagcacagtccacagtttaaagagaaacactggaagcacttcaaatgtcgattagcagtggaatgaataaataagtgatttattcatgcaatgtattcatgtgtgcaatgtaaaacta

SEQ ID NO: 106812 - DNA, 319 bp, Homo sapiens
gtgcccaccaacggccagaagaaccttccggctgctgcaaagcccagcaggctgggccagtttctcgctcatctgattgttgtgagcagaggagaacgagttactcagtccccagccggccgagggcggggccgccttcatctctgctccatgggctgctgggtgctcacactctaaagtgatgtgggtggcaggaagtggccttgtggcgcccacctgctgagcacagggctggcctgtggagccaccccagtcaagctggctggggctctcctgcccctctctgtcttggcacaggcccttcccaggcctgcaaagc

SEQ ID NO: 106813 - DNA, 733 bp, Homo sapiens
tgcttgagaccaggagtttgagactagcctgagcaacgtaataagaccctgtctccccaagaaacaaaaaattagctgggcatagtggcatgcacctgtagtctcagctacttggagggctgaggcaacatcgcttgaacccaggtgttcaaggctgcagtgagccatgagcatgtcacttcaattcagcaagggcaacagagcaaaactctacttaaaggcaggggaaaagagattcttgtttttaatcaatagaagaattacatttatctttcaaatgttttatcagtatattttaacatctatccatcatcaaatatttactgttttatgcagaggtaacaagagagtgtatttgctgttactgaattttggtaattgaatatggtaatttgggtttattattgtctttgctctcaaagagactaatattaacaaatttctgggagagaatgtgcttgtatgtgtgtttacacaacatagctcattgtgtttgtgttgccttagaataaataattcaggaataaaatttgtgttggttctaaattaattattcttcatcaactttttgaccttagaaccaacacaagttttattcttgaatcattcaggattttatctgagtatccctagttaactcaacctgtgcatacccagcctagaatatggacccatcccaaacaactgacaaaacacaaataagttaactacatcacatctattattatctttg

SEQ ID NO: 106814 - DNA, 376 bp, Homo sapiens
aagggatcaaggatggggcatgatatagcactacctatgacaggttttgtaatcaggcagagctgggttcaaattgtgactacattatttctgggctgcttaaacttaagcaagttatttcatcacagaaccttggtttcttcatgtgtacaacaaacaagacacctactggagagagaaactgtctcaaattatcttttttctctactctcacaccataatcatcaacacaagagacttctgtgaccaaatgtgagggggtttcttccccacacaccaaccagcggacagcagctgggtatcctctcattcagttcccatgctgtctacctggagagagtgtcagatcccacaggttgagggctcagtccccagg

SEQ ID NO: 106815 - DNA, 250 bp, Homo sapiens
ccccaaggcccaccacacgtccctacccaggaaggaggcgctgcacagtgaggccagctgcaccgccatccatctttacttacaaaaacaggcagtggccgggagcggtggctcacgcctataatcccaacactttgggaggccaaggcaggtcacaaagtcaggagtttgagaccagcctggccaacatggtgaaaccccatctctactaaaaacacaaaaaattagcaggtgtggtggcacatgcctg

SEQ ID NO: 106816 - DNA, 291 bp, Homo sapiens
atatagctgattgaaacttgaaaattcaatatggctgagggacacataattatctaacaaactattcagatatttttcaaacacaaatgtgatacttattcaggataaatgtgataccaaatatataataaagtcactataatttccaaatcagatttcactgaaagcgtataaccaaatcggaacttaaaagttcactcatagttatgaagagatttggcaatgcactgtcaggtactgtcacacattatcttctctaatcttcataatagatattaactccttgtttca

SEQ ID NO: 106817 - DNA, 485 bp, Homo sapiens
acagggcctcacctcactctatcatccaggctggagtgcagcagcatgatcacgggctcaagccatcctgccacctcagcctcccaagtagctggaactacaggcatatgccaccatgactcattaattttttattttttgtagacatggggtctcactatgttgcccaaggtggtctcgaactcttggacacacatgatcctcccaacttggcttcccaaaatgctgggattataggtatgagccaccacacaaggcaaaaagatgctttagcgtaattttttttttttttaagctcttgaaaactgaagcctatgctatattaaaaaggctctcatcacccagctttccctcttatcatgcagaatcaaattctttataaagaaatggatagcattttaacatatcactggctatacatactaccccatcataacaaaataaaaaatgtttggctttttggacaacacctagttgaaaaaatt

SEQ ID NO: 106818 - DNA, 540 bp, Homo sapiens
tggagacagaatctcactctgtcacccaggctggaatgcagtggtgctatcttggctcactgcaacctccaccttccaggctcaagcgattctcgttcctcagcctcctgaatagctggaactacaggtgcccgacaccacgcccagctaatttttgtatttttagtggagatggggttttaccatgttggccagtctggtctcaaacttctggcctcaagcgagccctccaccttggcctcccaaagtgctgggattacagatgtgagccaccgtgcccagctgccattttggttttcagatgtgttaaactgcatgtgtaggggtgggagagcagaggcctttaaaatgcaccccttgccagtagtgggtttgtgtgtgtggcgttctccacaggacttcttgaaagcaatgccagcttagagtaggagctgctttgaacagcagacttctaccaaatcgtaattacttaaggagtatcattatagtaatttagtttttataattatcattttcttaccttgggaagaacatcctaag

SEQ ID NO: 106819 - DNA, 404 bp, Homo sapiens
gcttatacacccctgcagtaaggacactgatattctgagcatgggaaccagaggtagagggcacaggaaatgaagggcacaaaccttataggggcacaagccatgtagagaatagtgagaaatcacatgtggacagagcataaagaggcaggagtagagactggaagtgtagcataaggtcaaattgcgtgcattctatggagaaaggggagtaaatttttttagtaagtaaggaacaggcatggcaggtgtattagtccattctcacactgctaataaagacatactcgagactgggtaatttataaaggaaagaggtttaattgactcacagttcagcatggctggcgaggtctcaggaaacttacaatcatggaggaaggggaagcgaacacgtccttctt

SEQ ID NO: 106820 - DNA, 521 bp, Homo sapiens
gaaagggctcttcgctcccggaagagagagaggtttggttttggtttgatatgcgagacgaaaatattagaaaaattaagggatggcggttgtatggatgtgtatggttgtaaaaaactacctagctctacgcagaagagggcatttaattgtacgttttttattttccggtttttaaatagtgatcagtagcgactgtaagcttttctttttctatcagttgaataaatcaactgaaatgccggttttcacctgggtggtataatttatatgcaagtatgtaaaaatgattcctaattagaacttgtagtattaagggtgaaatttgaaaccttcccagtctttgatgtgatacatttatcctggcgaccttcgaaggtctctcagcctttgatatgatacatttaaggtgtgaaggataagcttaattattttacataatgggatgtagaaagcataaacgcaatttcaggtcacttgtcttattcatcggtggattgtaaaagtggaatattgccagg

SEQ ID NO: 106821 - DNA, 365 bp, Homo sapiens
ccaatattctgcctttaccccggaggatgcagatgtaccttctctcaggccgatgacctcaggcctccacggtccctggagctctaggaaaggtgagcgcgatctcgtgcccacacccagtgctctgggtcataagcctggatctggaaaaacaaacgccctttgagaagacggggactcgccaggatacccctctctcccctcatccagcctccagcccacccgattcctccccacctcctccacctccccaggccccactcacctcctccaactcctccggggaaacccaagccctgccgctcatggaacagaagaactggaaccgaagtttctggaacaggactatctgagagcggttcttc

SEQ ID NO: 106822 - DNA, 307 bp, Homo sapiens
actcttttactctttccgatgacagcttcccttgtggcttaatagaggttattaaccactttgttatatagaaggatgaattattaatttttttgtcttaaattttttgtctcactgcaattgtgaggataaatatattcattgcatatgtacttggagctccttagaggaaataatcttttttacattttctgcatttccaaatacaacttgcataatatttatgctattaatgttttttcctttgattttccaagtaatttgacttttctcataaagaatatgagagtcatgaattttttatggt

SEQ ID NO: 106823 - DNA, 536 bp, Homo sapiens
atttctaatggaggtgtcacatacggtcaaagcaaggcagaacacagacttttctttgcgtggtttctaggcacatttacaaagctgcattcagattgatgaggagcttcatcattcagtttaatgtggccaactcctccctctttttggaaaaagagcaggtgcactaaaccagcaaacacagccagcactgggctgtgctgagagcagccacataggggtctctacagacagaaacccgagaagaccgggaaagaaccaggacccagactcaaatatgaaaaatctctgggctttgtcctacggccttcccatgagtaactcatagccttgttccagtggaatctggccttcactagtctcagtggcaagttggttatgtggaaagtctctcttcacacacttgtgcgaataacgataaagaattttgtattgttttcactctacattagaccatgagtatttatgcctgtggctgcagtttgtattagtttccggccccaggtatctcctgcagcatgcagcttcagtcctat

SEQ ID NO: 106824 - DNA, 419 bp, Homo sapiens
ccagtgttgcactagcctcttcccacacccctttgacctgggtatgttatattcaccaagtctcttctatgactttattcaacagctaacacagacgtaaagcttgtcaacaccccaatcaagattagaaaaaaaatctaagggatatttcatgaatgtttactttggaacatttgtgtttctcacaccagggaaaaataacatgttttggaagaataaaattaaatagtgacatttgcttagacactcatggatgcaaaacccaatccgcactggttatttgataatggtgttattgagagtgatcaactccaggccgagttgctgggaaacaaaggtcactgtcaagatgactcactgattttctctaaggatctattgataagctccttgtcaacggaggtactgtcagaagtata

SEQ ID NO: 106825 - DNA, 405 bp, Homo sapiens
tcaaacagactgtcaatgccgcctcccccgagccccaaagtggggggctccctccaaggagacactgtttgtagagatttggggtttcgcacaagactggaagatgaggctctgcagattcttgatcgtccgttggatgatccgttagcaaccaccccaccccgacgaggaggcgcatcccagggcgccttaccagaaagcccttggtcccctgtccagcgtggctcctctccttcaggaacacacgcacctacaacaagcccgcttcctttccttctccttcctgtgacaatccaggtcctcggcagtatggctcatcctcactgctgcccctgctcctcatcctctcagccctttgcacctcctgtctcgacgcagcccgtttcattcttctaactctgcttc

SEQ ID NO: 106826 - DNA, 939 bp, Homo sapiens
  misc_feature (871)..(871): n is a, c, g, or t
  misc_feature (876)..(876): n is a, c, g, or t
  misc_feature (879)..(879): n is a, c, g, or t
  misc_feature (886)..(886): n is a, c, g, or t
  misc_feature (890)..(890): n is a, c, g, or t
  misc_feature (892)..(892): n is a, c, g, or t
  misc_feature (900)..(900): n is a, c, g, or t
  misc_feature (905)..(905): n is a, c, g, or t
tggaccgggttgaaaagagatttcattgattctttttaatgatattggaaaatatttatgcaattttattttttaaccttttctccatttcattagttatactattaactttgataatcacaaaactatgtggaagaaatcattctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaatgctataggttgacaccgggtgaatgactcnggttntanggccatngggnantctttcanaggtnaaaaagaaggtgggctcgatggcggttaaaattg

SEQ ID NO: 106827 - DNA, 1987 bp, Homo sapiens
tggaccgggttgaaaagagatttcattgattctttttaatgatattggaaaatatttatgcaattttattttttaaccttttctccatttcattagttatactattaactttgataatcacaaaactatgtggaagaaatcattctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaaaatgctaattaagtttagaacaggagttgaaatgactctcagttttatctatagctccaattaggacaaaattactttacaaaaagcattaaaaataaaagtaactgtatggtacttcaggaatttgaccagttccttacaacttattcttggcaatattttgtcagtaatatactttcatacagatgctagagaaccatggtgtctgctatttacatgttatttgttcccagtgagctttatcaacatcaaccctgtttatataatatgttattttgctcttcttgatctgtgccttttgttttagctttatacaaaatgctaggtttgttatattctttatgtatcataatatataattcaacttttcctgatgaatgtatgctgaataattaaactaaaccatgtgcttagaaaagacaaagacaggttgtatatgcagttatgtgtaaatatttgacaaagaaaaaaaaaggaaaagaatcttcctgccaacaggtaggtcctgctggacaggacctgaaaattaagagatttttttttttaagcagtgaaatttaaaaatctattacctcaagaattttcagtcgatatgtcaatgtactgttccttctcagtaagtacagtgtcacatgctgctggcggtaaaagcaacccaagtgtcagatcacacaaattttagggacaagtctttcaaaagacggacaccttgtgatattttggagtctaatttccgacttttcgtaatgtcccaatgaccttttgttgtggttgggcttttataaaaaattattttcggttggttgttgtagaatggaagagtaatcttaattatgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtttttaaaagagaaaaatataataaaaaaactgagggggggcccggtcccaatttgccttatagggaggttattacaattacttggcggagtttataacgtattaatgggaaaacctgggttatccaattatacgc

SEQ ID NO: 106828 - DNA, 1923 bp, Homo sapiens
ccgcccccccatgcattaggcgacacatcatgaaacaagctcggggttaataatgcaggcggtacggcggactctgggatctgattatattttatgaaagagaggggtagagtaaattttttaattagacaatgttgatatgcagaaatctctcaaaagaaattgcaaaggaaaaattacgttgagatgaaatgttgagaaataaggagtatcttaaaaacctaatttcttacactttttagagcaatcaacttatttccaaattattatttcatgctgttgtttccatgaattgtgtttttagcatagtatatacttttctaccacgttagcatttacactctaattactgaaaataaaggaagaagttggtgaataaaagccagggaaactgggtttattctcattttccaatagcactaatgtataatccctttaaccttccatatggtgctttgtgtgatgagtatataacattcatatacgttattagtgccttatttttttcacttgactttatttcttatctaaagagccatatattttttgtgagtgttctttggtccctctatttaaagtgctaaggagaaagcatatctttagggatgtatataggctgcgtttgctaccttaatctactgtattatctctaaaacaggttagccaatgtatttttcttaaattcattgttcatttttaagctaacctatacaaatggatattaaacaccagaaattaaagccattaaaattgaattgtactttaaaaccataaaaaatgctaattaagtttagaacaggagttgaaatgactctcagttttatctatagctccaattaggacaaaattactttacaaaaagcattaaaaataaaagtaactgtatggtacttcaggaatttgaccagttccttacaacttattcttggcaatattttgtcagtaatatactttcatacagatgctagagaaccatggtgtctgctatttacatgttatttgttcccagtgagctttatcaacatcaaccctgtttatataatatgttattttgctcttcttgatctgtgccttttgttttagctttatacaaaatgctaggtttgttatattctttatgtatcataatatataattcaacttttcctgatgaatgtatgctgaataattaaactaaaccatgtgcttagaaaagacaaagacaggttgtatatgcagttatgtgtaaatatttgacaaagaaaaaaaaaggaaaagaatcttcctgccaacaggtaggtcctgctggacaggacctgaaaattaagagatttttttttttaagcagtgaaatttaaaaatctattacctcaagaattttcagtcgatatgtcaatgtactgttccttctcagtaagtacagtgtcacatgctgctggcggtaaaagcaacccaagtgtcagatcacacaaattttagggacaagtctttcaaaagacggacaccttgtgatattttggagtctaatttccgacttttcgtaatgtcccaatgaccttttgttgtggttgggcttttataaaaaattattttcggttggttgttgtagaatggaagagtaatcttaattatgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtttttaaaagagaaaaatataataaaaaaactgagggggggcccggtcccaatttgccttatagggaggttattacaattacttggcggagtttataacgtattaatgggaaaacctgggttatccaattatacgc

SEQ ID NO: 106829 - DNA, 178 bp, Homo sapiens
gacctttcccaagaaacggcttctatagagggggccctgcttctctctgtcggtggcctctcaggacagcgtcagtgtgttttgaactcagtgttaagagacaagattgtcaaaaaggcatgtgtcaattattctgtggtttttgactacacacacatacacacacacactccaaaaa

SEQ ID NO: 106830 - DNA, 462 bp, Homo sapiens
ggtaactgtattaaaaattcccatttaggaaagagggaaggggaagcctgctgcctgggtctctgcccagaatgtctgtctcctgtgagacaggaatagtcggtaagtgatagggcctgggaacctagtgggcaccggcttgttgacacgtttctatggtgggggaatcggttcttggtcagcaatctggctgctccagattctgcctgctgatataacttttctggggagttagccaaacctctaaaccccagaccttattcagagcttgaccttcttttactctaatcccaaagtactttgctctcctgtaattcccagaaaactgtatttgatttttaactgagggttgtagcaggacagtatgtagatatgtgtgtgtagatatgtgtggatgtagatgtgtttgtatgtgtgtgtgtatgtgtgtgtgtagatgtatgtgtgtatgagtgtgtgtgt

SEQ ID NO: 106831 - DNA, 334 bp, Homo sapiens
gggccacactttgagatctgctggtccagcccacggtgaggctgaacttgaattctagttgtagctgctatgcaagtttccaggattctggtattagagtaaaccttgctattttgtgctcctaaatatcagtattcttattaatgtaatcctttatttcatatgtttttgagattaaaatctgagtcatttacatcttgagatatactcatcctatgatattccatattacaatttcaacttgaacagcagaacccttttcccatagctcttggatcttccacttgtaatccccttctaaggtattccaagtccttggttactagtaagaatg

SEQ ID NO: 106832 - DNA, 398 bp, Homo sapiens
tagggaagcatttaccccagctaggcatgacccaagtctcatttccttgctcccacttcacaatctaagcgccacactcctgccaaaatgatctttcaaaatgcatagccaatatcctactgaatgggcaaaagctggaagcattccctttgagaaccagcacaagacaaggttgccctctttctccactcctatttaacatatcattgaaagttctgaccagggctatcaggcaagagaaagaaataaaaggtattcaaataggaagagaggaaatcaaattgtctctgtttgcagatgacatgattgtgtatttagaaaactccatcgtctcagcccaaaaactccttaagctgatatgcaattttggcaaagtctcaggataacacgttcgcgag

SEQ ID NO: 106833 - DNA, 329 bp, Homo sapiens
aatcctatctgcccttttatgcacaaattgacaagcagatgaattctgaaattcccatggaaatgtaaaggatccagaatagccaaaagaatcttgaaaaagaagaacagagttagagaactcacactttccaatttcaaaacttactatacaaagctacagtttttaatacatgtgacacaggtatattgatagctatatagatcagtggaatagaactgcaagtccaaaaataaattcaaacatttatggtcagttgattttcaacaagggtgccaagacaattcagtgggaaaagaatagtcttttcaatcagtggtgctgggaca

SEQ ID NO: 106834 - DNA, 481 bp, Homo sapiens
ggcctgaggggcaagtcccaacgtggaagatggttggagcgtcatgaaattcacactgaggtaaaacccctgaaccacataggaggccgcccctgacctgggccagatgataggaaagcagtagcctccacctgtggggtgcttctaggaggaagccagcctcagtgggagtgggcagatctgccagagtcggagctgtgccccctgttggccaggcgtgccacagtcctgcaagacagacatgttggggacatgaagcttggcaagacaggaagtcactggccgggtggcaagagccctgaatcagaccaggtctgtctgacctgagagttcggctttcaaccactcttcaggaagaagagggaagaagatagacttcttgtcctagagttttgagtagagacagaagacaggaatcacccctcccaccccttcatctcactgatgttagaagtggagagcagagaggacagtgtggcat

SEQ ID NO: 106835 - DNA, 361 bp, Homo sapiens
ccacctgtcactgtctttaaaatttaattcagataatatttattttaatatgtttgtcatttactcttttgtctttttcgtgataaatttgctggagcgtctttgaaaaggagaaaactgaaattcaaatacagccatctaattacttaatttatgagagtaagactcacagcagagtctgagttctatcccagactgtggtatcataaggtcacccatgtaggttattagattgtacccccaataatttttttttaactttcttttagagacagggtctctctcactctattgcccatgctgaaatgcagtgatatgattatagctcactgcaccctcaaaggctcaagcgattctccca

SEQ ID NO: 106836 - DNA, 381 bp, Homo sapiens
cacacacacacactcatacagacacacacaagtgtgagcaaaggactcaatccatcggaatgcagatcacaccatggaagctattgttctgtcaaaaaaacaaaacaaaacaaaatgagagagatacattcattaatgctgcagcagatggctgctctgcagaaggacacagcatgaggcaggctgccggctggcagccacaactcaggcagcattcactccagctgtaagttcaggttcctttcagaagctctgcattccactggcactttgcaggaaatcccttgggcttaatggatagctttaggcgcagtccattggcaatcaggactgaatcccttgtcatttccctaggtcttctctcccacccactctacttgc

SEQ ID NO: 106837 - DNA, 643 bp, Homo sapiens
gatccacctgcctcggcctcccaaagtgctagaattataggcgtgagccaccatgcccagccttatgtcatcatttcttgagcactcctttctgctttctagcacaacacatgtatctgtatttctatgtctctgtctataaatatatgtaaaccttgagtttacactgatacatccagttttaaaatttcatggttcattttagttttacttatactggctttttggatgatgagaaacctggtggctcccatgatccttaatatagtgacttgatcaaagccctatgtgtgactaattcccattactgttgctgcctcctcttctggagggagccctttttcttgggctctctcaccctcctatggatgcttgcttgctccataggactggattgttcagaaagggaaagaagggtaaaaaaaaaagaaaaacccaaacctatccatttttaaatactttcttatgttctgttgtttttttctttgagacagtcttgctctgtcacctaggctggagtgcagtggtgcaatcatggctcactgcaggctcaaactcctcggcttaagcaatcctcccacttcagcctcccaagtagctgggactacaggctcatgtcaccgtggctagctaattaaaaaaa

SEQ ID NO: 106838 - DNA, 267 bp, Homo sapiens
gggtggatgggatggagaggatggatgggatggataggatggatggataggatgggatggatggctaggatggatagattggatggatggatgggatgatgggatgaatggattggacggatggatgggatggatacatgaattgatgggatgataagatagatggatgcaatggatgggcatggataggcatggcatggatgggcatggcatggcatgggcatggatgggatgcagtggatggatggatggcatggcatcaggatg

SEQ ID NO: 106839 - DNA, 425 bp, Homo sapiens
tgagatggtgtgcgtcacatagagcgtgttggaggaatgatcgtttggttgtataagggatgttggctggccttacagatgagatgtttgaactgggtcttgagtgagtgggaatttgttagggaggtgttagtgcagtaggagcagagattgtgaaggcttttgtgggccttttgtgtgggagaaaggttatagttctgtggagtgtggggcagtgtgggccagatttcttgacacttggaagccatgagagagttttaagcatgcgacatatatgacttcattggcttggtgtcagaagagagtttggagaggagagactgagacagcaagtccagttaggaagctgttgcagaggcccaggggtagatgaatctggagacccagaggcccaggggtagatgaatctggagacccagaggccc

SEQ ID NO: 106840 - DNA, 667 bp, Homo sapiens
gttcatagtagaaccatactgtgtaaattgcaatctaagagaattatcaaggaccaaagtaaagtcaaggggatcaatgactaatatgcagtaatatttaccttagccctcaggcagatatgtgaaaagatgtgtaaagttaagaaatacctgtaaactccagatacaaaggctttctgcaaacaaagacctttgcttctttctaggaatttttgctggttttactgtggaatgagaacccaaactgttttgtgattaagttaaacaggtacatgattcaagcagtaggttttgtaggttatattcttgaaagaaggcctgggaatttttgaagccttggaaagccttgggtttttttgttggtttgtttttcacttgagagtgtttttaaactagaaaacaatttaaatatatgcgtgatgaggattctggggaggtgaggaaggcatctttgttgcatgtcagagacagataaaactttcacattgtaggctgggcaccatggcttacacctgtaatcccagcactttgcggggccgaggcaggcagatcacctgaggtcaggagttcaagaccagcctggccaacatggtgaaacctcgtctctactaaaaatgcaaaaattagccagatgtgctggcgggcacctgtaatcccagctactcag

SEQ ID NO: 106841 - DNA, 430 bp, Homo sapiens
tcaagtttatccaggtgatcctgatgcactagactactcaaggaaaacatactgctccctctggcttatctcttcctcatttataaatggtaaatatgagcaaagtgtggcataaagtaaataagtatgagacagaaaataacaagatcagaatctctaattcatattgtggataaagtatgatctagctttgttgaacccaagctatactctgtttaagagagtgtgtatgtgtgtgtgtgtgtttgtgtgtgtgtgtgtgaataatcagaaggaaaaggagcctggcccctgaaacattaaacagtactgtgtagaagtctctggaataaactgctaataggatagttcaaagtcttcaaggatttgtagagaaatctactgtatgtatcagaaatattaggtctcccggaagatgagggaccagaag

SEQ ID NO: 106842 - DNA, 287 bp, Homo sapiens
tggtgtttttcaatttttcaatgaattttttaatttttacttaaaaaaagacatttttttcatgttataaaattaatgtccactgtagacaagtttgagaaatcagaaaaatatacatttagataaacaaaaaatacataatccataattcctagagaaccagttaacttttggtagagaatcttccagtattctttatatgattatcttgtatttctctctataaatgtacatataaatacaggttcatatatagaaacagatcttttaaaaatggaaaggagggc

SEQ ID NO: 106843 - DNA, 1223 bp, Homo sapiens
ggaatgtatgatggagtttctgccatccacggtgggaagaactcatgcacacctcattagcacccaggtatccaactgagacactagaatggatgtgctttaggaataagtgtcacacttttcaataaggcctattgttcaccaacctggtaaagcctaaagccaaaccctgacaaaatccacaaaggggtggattggtgattgagtcctgccaaattagagggtcttgggaaattctgtgggctttccatgaatccgttgtaataaaacataaaccagtccacataagtccaaagtgatcgatcagacagtaattttacgcccactagagcaaaattaattcacacaatcaatgacacaagttagccaagtcgacatttaagcaaaatacatctaagaacagctaacaaataactctcctcaaactcacatagagcattcaccaagatagaccacatatgctgagccatccttagtattttctgtcctttctctttgactcgtgtatactgtgctcaaactcttaaaattatacactttaattatatactttaatgattatacactttcatgcatctcaattgcatgtaagttatatttcaatatatttgttaaaagtttataattaaaaaaactgtcctagcttgattccagaaatcttttttatattttagaaaatgtaatgttatatattatcagggcaaaagagaaaaaccgtatgattaccttgtcatacacagtaaaagcatttggcaaaattgaaaaatttttcatgatttataaaaacaaaccccagaaaactcagcatgataagaagagaaggcaacacttccaaccctattaagggtagatttgaaaaaaactcacaggtaacattatattaaatggcatgggattgaatgcttttctattaaatcagataaaaaagtagaatatctgttgttattctttcaattcagcattatactagagatctaaatcagtgcaataaagtaagaaaaataaaagtattgaaaagattgaaaagaaagaattgaggctgtctttattcacagataatgactgtgtatgttaataatcctagaaatctgcaaaaatctgccaaagctaattagtgagtttggtaatgttgcagagtataagctcaatagaagtagtcttttgtatttctgtgtattagcaatgagcatttggaaaatgaaataaaaatacaatttcatttc

SEQ ID NO: 106844 - DNA, 2077 bp, Homo sapiens
aattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggc

SEQ ID NO: 106845 - DNA, 1691 bp, Homo sapiens
cggcactaggtgatatctcattatggttttggctcacatttctctagcgatgttgggcatcttttcatgtactcactgcaacctctgactccctggttcaagggattctcccacctcagcctcccgagtggctgggattgcaggcacacgccaccacgcccggctggttttttgtattttgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggc

SEQ ID NO: 106846 - DNA, 947 bp, Homo sapiens
cacctgatgctggggtggaggtggagggtcgtctggtttattgttaccactactcttttctaccaccgtagtccttacaaggcttacagcagacagataaccaggcaaggcccagcgtgaccaggcccagactccttccagaaaagacatggcacaggtacccagcagtgtggatacagtgtcttgagcctcacggggcacctgtggctggtctgctgtggaaccatgagccagtgttggggaggagcaaggtggggcgaggcaggccttgcccaggttggcaaaggtgacctgagtcagcccaaggctgctccaggctagtgagtcacccagctccccacgtgaatggacatcacagccgcccagccctgtgctgctcggacctcagcaaggaaccacctcaggggcgccatggagaagttcttgtcatggtaggccccagcctcccaggggtcctgcagaggtaggggctcatggtgggaatctggggcagctaggagctatgaagggcatctgggcctcggggtcagaggactgggtccaatctggggctcccaactcctggctgcatgacctcaagcatgtcacttctctgtaaaactggaaccacaagcgctgacttgcaggatctgtgcaaacaacaagctcagtgcctggcatatgagtggagatccatggggctgggtggctgccacccactcctgggatctcagagaccaccactggaagacagtccctaaaattcaaaggagaagctccaatcagacttgggcacgtgcccctcaacaccttcccacttgactcccccagcctgtgctcccctccgtgggctgtggctccacctggctatgccctgccattggaccctaccccattttgcatcctctgctctcagcctcttcctctccctggctgggggatgtgagcaggaatggctcaatcaggat

SEQ ID NO: 106847 - DNA, 418 bp, Homo sapiens
accacatattctattgagtctatttatataaactgtatacagaataggcaaaatctgtagaaaagtggagaccacttgttgcatagggctggggaagtagtgggcatagaggaattaagaagtgatgattggccaggagcagtggctcacgcctgtaattccagcagattcagaggctgaggcgcgtggatcacttgaggtcaggagttcaaggccagcctggccaacatggcgaaatgccacctcaactaaaaatacgaaaattaggcaggtggcatgcgcctgtagtcctagctacttaggtggctgaggcagggggatagcttgaacctgggaggcggaggttgcagtgagccgagatcatgctactgcactccagcctgggcaacagagtgagactgtctcaaaaaaaaaaaaa

SEQ ID NO: 106848 - DNA, 762 bp, Homo sapiens
gcttgtccattttgtcggatgatctccagtggtggaggatgagtgtgctgattggattaattccgagttggaatataatgaatggttagtgtccttttactccgttgtgttttgaggtgtttgtccctgacagccatttggcaaataatctggttatccaaaaagatttttggttttttgatttaatgctttaaacttttcttattttttttttacttataatattaaacatgtaaaagcgattttaatgacttttcattgaagatatacccttctgcctccatctccccaaatgggcatgcgagaaacatcactactgaatagtctgggaagtaagtttgcaccaccaaaggtcagtgtgggttgtataaaaaccaggactggaagcagccctcccaccccagataataacggcaattccagagaacattgagaacacaaaccctcgaagaaagagcaaaatttctctgtcatgtaatgatgtttgatttgggctaaaaggaatgtccattttaccaaggtcttaagttctctttttgattccacttttatgcattttaaaaagttttcttagctgccttccttgttttccaaaaatatacaagtgctgatcctcttttgtccttcttggggtccccaggaatcagagaatacaatgtataaaactatagcaccagctgggggggtgcgaggccgaggcaggcagatcatctgaggtcagcctggccaatatggtgaaaccctgtctctactaaaaatacc

SEQ ID NO: 106849 - DNA, 347 bp, Homo sapiens
tacttggacaccagaggccaaggaaacaacagccaaggacaacagaatccctgcctaccccacacgacatgttgctcattaaggccccagaatacagaatctgaattgagagattataagccagaatatgactgaatgaattacaggcctgaactgacagaaacggcactgaacttgctgagcaaaacctggcccagggctgatgagatggtttgctttcacagccagaaattcaactgaactttgggagtcaagaacatttcatttttttttttttttttttttttttttttttttttttttttttttttttttttttttttttttttggggggcccccccaaaag

SEQ ID NO: 106850 - DNA, 368 bp, Homo sapiens
tctttgtcaggtatgaaaaagaaatatactcaaaatgaagagtaaatataattaaaacagttccttgccttaacatataaccttcttatgggcaaaaatctttgtaaggttaatactgtaaaactttgatttaaaagaaggaataagaaagagtaggcagagagaggaaggggagaggaagaagtttgatttttgtaagagtaaacagaaaatgatagtaaatgaaatgatattaaatcattagctgcttttaatgatacagttttagacccacaatgtatatatatatatttttcaaatttccagtatttggcatgtacctgacatacagtcatctcttttcaatagttaacagaatgagtgatatt

SEQ ID NO: 106851 - DNA, 291 bp, Homo sapiens
cccgctctttgccttcagttgtattctatatgtttaatacacagcacagcagaagcaatcagctctccccaatgttacttatcccataaatcatctttccttacacctacgtattttcttctgtattcaattttattaatggatcatctgatctccagctttgctggtttagaacctctgtgctcatcttaagctcctcaaggagaaaaggactattgtaatcatctttcaacgagtttgtaaaaacaattcccccatcacagcactgtgcctcatagggtttaaaatttg

SEQ ID NO: 106852 - DNA, 314 bp, Homo sapiens
tgcttatgtcacagagctccaaaatgtgggctgcgtgtgcccaggaaaaattataaaggccagtttaaatacagcctatatttctctctaccacttagattttttctttattttcaaaaacaataattttctgaagttaagtaaaactggaacatggaaaacaactacttgcgaaacagtccacaggactccatgacagcctccattctcctccttaagacggatttgcatcaaacttctccatcacactggaccaaacacactctattttgtcttaggaaaccctgaggaacatgaatttttaaatgctatac

SEQ ID NO: 106853 - DNA, 234 bp, Homo sapiens
ttttttcctataatcttatgactttaaagcagaaaacactgtaaacacctgtcttagttggctaaggctgctataacaatattaaatatcacagattgggtggcttcaacaacggacatgtatttctcacagttctggaggctgggaagtccaagatcaaggtgcctgcagattcactgtctggtgcggatcctcttcctgtctagtagacagctgccttcttaactgagtgct

SEQ ID NO: 106854 - DNA, 468 bp, Homo sapiens
accttagggggatgctaggaactcaacttgttcttctgcaaaaaggcaaataaagtcaaaggatcaaggcggtattctgcctttcctatgcaaaaaggactgcccagtaacccatagctcgagaaggctctctttagataggtggactccagctaatacacgaggaaggaatgctagacctgaaagtcaccattttgccgtccctaatctcagccctgatgtagtggctgctaacatcacaaaagacagcctctgtcccttctaatccaagaccacacacagcagcacttaggagagttcttgccaaaacaatcttgaatctgatcaaacctctagatctaaatgacaacttaaagcaaatacaaggacagaggctcacgttcaacagcaccatggggacacggtacgacccagactgggaaatcgtagatggcaaaggacaggctcatcaatagatttcaaaatgaa

SEQ ID NO: 106855 - DNA, 364 bp, Homo sapiens
tgagacagagtctgctgccttccagtctaggctggaatgcagtgatgcaatcttggctctcagctcactgaaacctccactagctgggttcaagtgatccttccacctcagcctcccaagtagctgggattacaagtgtgcaccaccatacctggctaatttttgtgtttttagtagagacagggtttcaccatgttggccaggctcgactcaaacacctgacttcaagtgatccgcctgcctccgcctcccaaagtgctgggattacaggcataagcctctgtgcctggctgtaactcaggtaaattttcattggctcattcatatttcccagttcccaatctttctattgctcctatttaac

SEQ ID NO: 106856 - DNA, 507 bp, Homo sapiens
tcagtgtggtcatctctgggcagagatactatagatttactgctaacattgggaattggaaactagaatctcttctgagattctaaaagcagggtgtttctgctgccatccttgctgccctttgccacatgcttcttcactttatgtgttttcaaatcacagttgcccatgggtgtgtctgatgagggaaaggtcacatacctgtaccctagctgcaaaagagctggagatttcaggctcgttgttaagggtctgcggattcataaggtcagaaattccatgaacacagaaaaagtattcaaaaggtactcagcagctagtgaattcaactggggacagttggaacttcaggatgtttgatgactggggagagggtctttgttaagaaaaagcaataatatgaaatattaatgctttccaattttatcaagatgatagcatttttgtgtactgaattacatgcatattacatacataataaaattgtaaaactctgtaactaggaag

SEQ ID NO: 106857 - DNA, 308 bp, Homo sapiens
aaagaaggcatcacaattaattctacctccttacgttcttaatgattccactttatctgtggtttaggaattgggtggtggggcttaggtgcaaagaggaaagaaaaaggaaaaggtaattgatacttaggaaaggagcctaaagcccaaattcctcacaatgattctactccttttttcccccgtcatttcaaagtcccaatgcttaaaatatatgtcaagttcaaagacttacaaatgtaaaacaaagatttgcccatggattgaatggtcataccacattttctcagatactgcagaaaggcttg

SEQ ID NO: 106858 - DNA, 308 bp, Homo sapiens
tgggggttggggggacgacgggacattacacgactttagtgccaagaaggattctgctagctggtttaggagcttagattttgctttgctagctaggttttgtttgttcatagcaggacagtgaggtaatcagatatatggtctggaaagatgctccagctgtgggttcatggtggagtacaatggccagagatctggggtgggcagacctgggctctttttttcctggtattttcttctctgtagcctctttttcattcacctttgtcaatctcccctccttctcccggatacccatttctccctcc

SEQ ID NO: 106859 - DNA, 272 bp, Homo sapiens
gtgtataaaaagagttcttctgtctctcattatttgtggaatctatagacaaattattagaattaatgagagtttagcaaggttgctggatataatttatgccagcagtaaacagccatttaaaggaaataatgcaatagcatcaaaaaatatatataaaggtacctaagaataaatccttttttttttttttttgtcgcctgggcagaggttgcagtgagctgagatcacaccactgtactccagcctaggtgatggagtgagactgtctc

SEQ ID NO: 106860 - DNA, 257 bp, Homo sapiens
aatgctctaggaaggatgtcagaacccataaaaaatgatgagtatttgaaatatatgtaaaaacttaagtaacaaatcagaaaatatattctgagatagaagtgaccattctaaaactgtgctgtacaatacagtagtcactagctacatgtagtttttaagcaatcgaaacgtggctagtctgattgagattgctgtgaaaaatacacactggattttgaagattagaaatgtaccctaaaacttaaagtataata

SEQ ID NO: 106861 - DNA, 458 bp, Homo sapiens
ggtgaggatggagctttcataagacggagtgggagtctctaaaaaacattttttaaagtttttttttaagtactagaacctgtggttgatcctagaaatccagcattcaaaatcaccttatgttagtaatttggatgtgacaggtgtctggctgtgaaagtatcactccattaatgaccaggtgtttcacgaaaaggtcatataggcaaagcaacccccaaacacagaaggagtcaaaaaaccaaagaaggaggcagacaagtccctcttgtcattacagggtgattttattggggaacttacggacaggggcatggtcttgggtagccacatgacaagcagatctcctcgtcattagacccccagacccaaggattatatacccagggaaggggtacacatgctccagaggaaatgaggaggaatttgatctaagggcaggatttatagtaagtacc

SEQ ID NO: 106862 - DNA, 391 bp, Homo sapiens
tgcccgcctcagccccccaaagtgctgggattacaggtgtgagccactgcacccggcctatttttcttttattaacattagctttagtaatttttcttcacagaactatgtatttgtgtatttgttgtcaggtttggaatttgtgttggctatcaatttaatataaagtcttagactttatagagtataaaccctcatttatttttgttcatcgtattcttgcaaaatactgttttgacttggtgacctagagtggatcaaggcactatcttcaagtggtttctgtagtagcctaacctagaaacactgcctgacatagctgagtggcaatgaaaaacagccataggtactaacttaaaaattagctatagaattgcaactggcagctaag

SEQ ID NO: 106863 - DNA, 581 bp, Homo sapiens
tattcttgtgcatcggtatctttttctttttttattgtagtaagaacatctaacatgagatctaccctcttaacaattttttaagtgtacaatacagtattgctaactataggcatgagaatgtgcagcagatctctggaacgtttcactctttaaaactgaagctttataccccttgaatagcagcttcccatttccctgtcttcatagcccctggcatccaccattctacactctttctgtggggttgactattttaattacctgacacaagtggaatcatgcattatttgtctttctgtgactggttgatttcatgtagcataaagtcatcaaggttcatccatgtttttgcatatggcaaggtttcctttttaagtctgaataatattccattttctacatataccacatttactttatccctttttctgttagtggacatttaacttgttctcacagcttggctattgcaaataatgctgcaatgaatatctcataagtctcatatatgtccatacaagatcatgaaaatggacatgtctctgggtattttgaattggtgggacaattttgcttaa

SEQ ID NO: 106864 - DNA, 570 bp, Homo sapiens
gctccgggtctggtgcgcggtctggccgcgctcgggccctcgccaaatgagagcgcagcgcctctccgccttcggatccagagaaagagcttgttgctgcctctaaaaggttggagccttagtaagcggttcctgcctttcctgcacagaccagaccgccgggtgctggtctgcgctctgccgcgcgccgactgggacagcccacccacgagatccttgttcctgaaatccctttccttccctcatctgccaagaaaactttcaacttttgggctctccgcgcctcccaagcttcctcgaatccctgggcccttgactgttctgccctgatggcacttggtgagagatccattgagagccctttccgtgccttcctgaatattgatatgttttccagcctctcctcctgcgctggcccaaggactcattttccgtccctgcttcctcactaaaaagagggtgcccaataattgcttgttccatacagaaggcagggaggccgtctctaggttttctcccactcagatctgctgtcctcacagccacctccccaagaggaatgaaggtatt

SEQ ID NO: 106865 - DNA, 650 bp, Homo sapiens
gagccagtagtagaagagatctaagctaggcaagggcacctcaacctagtcctagaaacaatgcaatattatctattgaagactccacctcagtgttatcactgacaagcagagagtgctgtgttaaaacaacgcagtgaagacaagaggttaagaagctaatggtaaagaagaaaaactaaaggcattgaaatagcaaccgttgtgatgcaaatttattcttatgtaaatgtagaaacttgctagttctttagagctctctgacaaatgtgcatttaagcaacaacagtcaattttccaggaaacatctttatagcatattttgagtggaccttttgaataaagcaatcagaaatgtttgttatgacaatggataataaaactgccacttgaaagaaactagcaattgagagggagcagcttgaccaaatatgaagaaggtaaaaaaattccaatggcttgctttcactgccagagtatctgaaacacactaagagcactgtcaagggagctattcttgaattttaattcaggtccccaacatgtgtctgtctcttggtttacttgggagaaaccctgaaggctcagatagtctttggaataaggtcactgtagaagactgacaaggggtccctggatgatagagaggg

SEQ ID NO: 106866 - DNA, 401 bp, Homo sapiens
ggaaaaggggcccaggcaaggcagggcccatgagagttcctagtgtgacgcttcaagtgtcctctcatggaggtgtgaacagtgccaacttctcccagcatgtgacagcacccagagaccattgccccccagggaagcccacctgagactcactgtctggagttttgttgggtctcagttgtgtggattggctggccttagtctccagccctccagaggctgagctggcgctgtgtgcccgaggcctccaccacagggttagcacagactgtggaagtggcccagggcacccagttagacagacattcttaccaggcaggactttccaagggtctagagatctcccaggagctgggggcagaggcgaggcctctctggcagggttaaccctttgccttgca

SEQ ID NO: 106867 - DNA, 494 bp, Homo sapiens
cggaagtcttgaactgggttcgagttcccgttatagagaaaggtaatttctaggactttccctaaagcatcaacctgcttaagggttagacacagcaccagatctacaataaattaaataatacatttgacatgtttgcctccctgtaggtactgcagtgatgatttacaaatactttctcttcatatttcactggcaaggggtcaaatatttctggtcctctattaacatgtatcaataatcagaaatattattatcgatatgaaataagcaaactgaataattatcaaccaaccaccatagaaaaagcaaggcaggctaaacgtggtagctcacgcctgtaatcataacacttgggaggccaaggtgggtggatcacttgtggccaggagtcaagaccagcctggccaacatggcgaaaccccatctctattaaaaatacaaaaattagctgggcgtggtggcgcacgcctatagtcccagctacttgggag

SEQ ID NO: 106868 - DNA, 387 bp, Homo sapiens
gtttggaatgttcttccctacactacaaaggagtaagatgcaaatgacccagggggtatatttcatcagtcatctcctagagagacagaatcttatgcaatcttctttgaaaaaaaaaaaaacaaaaaagaaaaaaattacagagacagaaagaaagggactctacccttccttaagagactgagtattggtactgctcatattccaatttttctcttttcagttactccaataagtcccgcctctccttcctccagtttggctggacaagctaagttttcacatcatgcactcaaaatggggaaggagaaacttgtccattttctctatgtctggaggagcaggaagagccacagtatccagaatcatagcttcagggagaggaag

SEQ ID NO: 106869 - DNA, 862 bp, Homo sapiens
cacgccaccacctccatgtctgttgacattttatttgtccttcaagatttaactttggtatcgttaaatctcttgaagcctttctagatcttaccaagagaaaataatttccttatctgttgtatcatgggactttattaaaactactgatattatggttatctatacacacatttctttcctctattatggattgtcttttattttgcaatatacaacagttatttgagtacttactgtataccaggcactgttactaagaggtgggggtataatagtgaataacataaacttggtctctgtcatcatggacctaacagtaaagtacattaattgtgtatgttcagcatttgctacagtgtttgacatgtattctgatctttacatatgtattcatattagttattaaggactgttaggagcaatgatacttaaatgccttttaaagataaaatttagatggcctgaaagtggttagtcacactaacttatgaaaatatatgagaagatagagataagtattttggtgtcatgtgtttagaccatagacaacaacgtaaaggaatgaaaagaccgcttggaatagttgaaaggtagctgagctgagtcagagctagataatagtcttggctttgccttgaattaggtgtaatcttgacttactaacttcatctgtaaattgggaggttttggggagagagaatacttttttttccctgagctttaaaatttaaatcataaaattttaaatttgatgatctgatgagagtatagtaaagatgatcctagcagtattattagggaaagcaaatagtttatcttaactgcctttatttgtttacatttattgtatgtctatttt

SEQ ID NO: 106870 - DNA, 399 bp, Homo sapiens
ctgggcatccacccctgcgtttcccttctgttccccattttcctctagcttctcagtgataaatgatcacaaatcctgttcttccttcctaccacttgattcacagctcctacctgatttcagaatgtttttgtctaagaaacaactttcttctggcaggaagcagagatgaggtcaggctgctcatgctgttcacactcccctgacctctgtcccctggcatgtggggtgctgttcaccctcccctgcatgcctgctgtgttctagggtggcccttgggtatgaattaaacataaattatcccagagggctgacttcctccatcaccttacattcatcttctggttttaaaataattctcatccatttcatttatgaaattaaaaccaaatgcatact

SEQ ID NO: 106871 - DNA, 250 bp, Homo sapiens
gggagagtaagtagaaaccaccggatatacaattgcattagtcaggattactgttactagttgctgcaactaaatagccttaaatcaccactggtttacacaacacaggcttattccttgctcatgctgcatctccagtgagagccaacaggagtgtctctctgctccatatagtcactcagggccccaggctagaggagacattacagaagacatgttgtctttgagatctctatggaaggaagagagg

SEQ ID NO: 106872 - DNA, 352 bp, Homo sapiens
cccccggcctgctggctgaccccagacacagcagccttgtgtttcctccctcctggtcagctggtgcctggtagctgcagcggtggtagctgcagtggtgtctctccagaaggttctgggggagagactgaaattcccatgcttagccttacaatgccccggccccgtgcaaacctccagatgaaaacacagccccggccagtgcggtggctcacgtctgtcatcccagcactttgggaggccgagacacgtggatcacaaggtcaggagttcaagaccagcctggccaagatagtgaaaccccgtctctactaaaaatacaaaaattagccgggtgcggtggcgggcgcct

SEQ ID NO: 106873 - DNA, 664 bp, Homo sapiens
tcacattgatgagatttccaaccttttagctcaccaaccttgcttctgcctcagggcctttgccctttctgtgcatctgcctgaagctctccccagttctgcagacagctaccatttccatattcaggtcttcagtcaaattgtccctggttgctaatgagttcttatttgatgaccatatttaaaattgcaggtatacacatgcacatgtatgtacacacacacacacacacacacacacacacacacacacaatctcccttctctgctttatttttttcactgactgttctccatcttacatactaaatattttcctattttcgtttgtctcctgctactagtatgtgagtccatgaattcaggaatccctctgctctgtattctctgaattcatttctgtgttcccagtctccagaacaatgtctggcacttaggatatccataactatctattgaataagtgaatgaatggtggccagcctgcccacactgtctacagcatcaccacaattcattttccacctaggcacttacctgcagtctaaagttatcttgtttattaatgtgtttccttaattatcacctgtgtctcctttcctgaagtgaaaggaagctccaagtgaggacaggcctggcttaccttgcttaactgacattccag

SEQ ID NO: 106874 - DNA, 868 bp, Homo sapiens
  misc_feature (187)..(187): n is a, c, g, or t
acaggatattcaacagcacctgatagaatctgttggaccctcaaaatctaaattctagaacctgaataaaaacttctctttgcgatagtctatgattttcagaaattacaactaaaacctttaacattttttttttgaaatctacatcacattaagctctgattattattatttttttttttagtcnattgctcttcatagaccaaccatgttactgaatcagatcaaaagctgtggagagggtaaagcacaaaacaaaaaccctcacaggggaatcttaacattttgagggggagcagtgctccgcagtcagtacacacaggaggtgacaagcagactatttggaaaccaaaaaatatcaaagatgctgtaggagaatgtacaggaaaactttcaagtgtataagttgaaaatgatgcagaaatgtagaggctatatgacatgtctttgcatatttagtaccattaattgaaaatttagcacattccaagagaacgtgttcttaatcaaacttcaaaactgacccatcaaagtcaatagggcaaagcaccaaatacctgtggatgtactcctgggaactaaaaccaaaatacttttggaggttgcaaagctgctgtactgtgccaatgtcctttcttatacatgtacatatgtgatgacggcttgagtcagctgcagggcagggggctcaatgagagctttgtaaagacagctcttcacttcagctcattagctttggtaataggcaagtttgtttcccattataatttgatcattcttgtgattaattcaatgccagttcttaaagaactcttttatttctgtatatgaagctgatgtttaccttggaaatgttgcaaaatacata

SEQ ID NO: 106875 - DNA, 1155 bp, Homo sapiens
cgtttttggtagttcatgttccagtcagaagaaaagaccagtgagaactgggatttataataattacaatcatcaaaattaactgagtacagtgctcagcaatttatatcaatttcatgtaatcctgagaacccttttataaggtaggcattgcactgattcacattttaccagtgaggaaatagaagtttaggaaggttgccaaaaacttagaatgacctttctaaaatatgtctggttctattagtctttggtttaaaatcttaccatggatttatcttcaggataaaataaaattctttaacacagaaaaaaagacccttccatgctgtgagccttcaggattcagtggttaaccagtatcatctttctaacttcctgacctgcaagtctccctctgaccacactgagctttcacccttccctagctgactgaggtgttcttgcacctccaagaatctgcacacaatcttttcttcttccttcatatccttctggatctggctaactctgactatccttcaagacatggttgggtatcgctttgtctgggagaataacctgtatgcccccaaagatgggggataaacaccctttctagatgatctggtagtttctgagtctgcttctaacaaggttaactccaaattcctcagcccaagactgaagggaactccttttcactccttttacccggggactctcacccgtgcagctctctggcagccggaagtccaagatgcccaggactccttagcaagcccattccacagtcctccatttagggaattttagtagagtctgctgaatttgtccttaaataggctgacctacaatgattttttaaaatgtatacaatccatgcactgcataacaacttttcagtcaacaacagatcaaatatatgatggtgatccccaggacctgaaaatatcctattgccctggtgacattatagccatcagcatgtggtagagcaacacattactcacttgtttgccagttgtaaaaaagaatagcacatacaattacatacagtacgtaatacttgataataataaatgacgatgttagtggtttgtatatttactgtactatatttttcacagttattttagggtgtactcctatttattaaaaaaaatgttaactata

SEQ ID NO: 106876 - DNA, 381 bp, Homo sapiens
catctcagaaaggcaagtttcatctgcaaattcttggtctcacaatgaaccataacatctctgccatggcccagttagcatgccgggagctatttgtcaaaggacaaataattctatgctgcagaagaaatgaccttgctccagagaccaaaagctctctgttataattctgtcactgacatttgctgcaaactataaatggtatatgtttttccattagtgatatctctaacaacatagagtcttttgcttatgccttctgcatggctttctgtctctgggttctacttaaagatggcaggtttcggttcatctagtagctaaaatagtagccctagtaaaatgatgacatcaaaactcaaaaaccactgaatgttttcc

SEQ ID NO: 106877 - DNA, 370 bp, Homo sapiens
accttctggagattaagatttccaaatatgaattttagagggaacacaattcagccataacaaaggctaagtaagaacctgtttaaaatcctggatgtcttttcttgctaaaggagctgactcttagttctctccttcagctcctggagattgtgtaattaactggaggaggctcagaggtagaaggagcctaagatactatctattctagcctctcattttgcagttgaggctgaagttcacagaggttaaatgacctggttctgagtaactggttggacagctgtacccaagaggttctgataatggatagttgtcagcttcctatcaacttccttcctttaaagttaacacatattcattgtttttt

SEQ ID NO: 106878 - DNA, 438 bp, Homo sapiens
ggtcaggaacctagcattgtttagactaaaaaatatccaattttagagatggggttaactttttcccctaatatatttattattgttaatactgctgtttaacactcattccaaaacttagtggcatgaaacactttttattatgcacatcgattctgcaagttgtgccctctgaaagggcacagtggggatagatttttctcagccatgtggtgactgggatctcagttgggaagactggaaagttgagattgacacacttgactcctgggggccaaaatagtttgatggctttttcaccaacatgtctggtacctaggctagcattgttgaccagactgccttcatgtggccttgcttgtgtataacctggcggcctcgaatgttaaagtgaacaaggacaaatctgcgtttttttttttgttttttgtttttttt

SEQ ID NO: 106879 - DNA, 225 bp, Homo sapiens
tgctaggttggatgaattagatagtcatggagaaatagaattcaacaaagagggtatgatctaatcgtgaggcagcttagcaaggccgatttgttcagattcttcttggcatctttgtgtctctggctcctttcctccaggaatagggagggcacctcttgaatgaaggtcttatgatctgcttcaggggaaggtcagaaaatccttacctggttttatgaccta

SEQ ID NO: 106880 - DNA, 383 bp, Homo sapiens
tagcatctcctggtgcatgcaaccacctaccacaagagcttgactggcctctccacttcccactgctccccgtctgcaccacccccagatgcccacacaccacagccagccttctgctgaacgcggccttcatgttgtcatcttcccatttaagagccctccacgcttcttgccccttccactgatccaaatcctaactagctttcaaggcacagctaagatcctgcctgcttctggttctgttgaaggagcattagcttggatttgggaggcctctgcctctagccatttcttttctttgtgaccttttgcttcctgaggcaggtccttatcccatcaagcttaccgtctttgggtgtggttcaccgataataagagaatca

SEQ ID NO: 106881 - DNA, 268 bp, Homo sapiens
ttgaaaatctgaagcaaatgacaaaaacttttgacacagtatcaatataaaaaacttagaaagtacctgtattaattttgaaatgttatacctataatactttcttatctattaaataactacagctccactcctagaatctatgattaaaagtcgtaacacttagaaaagactttttttcagatgaaatatgagaattacttagcctagatttatcagccagtttattaaatctgacattcaccaaatatatttaaacatctactat

SEQ ID NO: 106882 - DNA, 784 bp, Homo sapiens
aaccaaacaccgcatattctcactcataggtgggaattgaacaatgagaacacttggacacaggaaggggaacatcacacaccagggcctgttgtggggtggggggagtggggagggatagcattaggggatatacttaatgtaaatgacgagttaatgggtgcagcacaccaacatggcacatgtatacatatgtaacaaagctgcatgttgtgcacatgtaccctagaacttaaagtataataaaatttaaaaaaagatttcttgccactgaaaacacccagaaccaaagccaaaaggactacaaaacattatatattatagacacctcctcaaagggagaaaaatcccatccaaattatggcaaaattgaaaaagtaaggaaagataatatatccagataaaagaacccgataaacaactcccaaagtattaaaaaccggagtattacaacaccacccaaggggaacactaactctacagcaacagatcctagccaaaatgaaatcattgaaataccagataaataattcaaaatattgattttaaagaagctcaatgagatccaagaaaaaacaataccaatagaaagaaatcataaaaacaattcaggacatgaaagaagaaatagacacaatttaaacaaaaaacttctgaaaatgaaaaatttattgaagttacaaaatacagttgaaagctttaacaacaggctagaccaagtggaagaaataattttagaactcgaatataggtcttttaaattaacccagtcagacaaaagtaa

SEQ ID NO: 106883 - DNA, 445 bp, Homo sapiens
tggagatggagtctcactctgttgcgcaggctggagtgcagtggcacaatcttggttcactgcaacctccacctcccgggttcaagcgattctcctgcctcagcctcccaagtagctgggactacaggcacgtgccaccatgcctggctatttttttgtatttttagtagagatggggcttcaccatgttagccaggatggcctcgatctcctgaccttgtgatctgcctgcctcagccttccaaagtgctaggattacaggtgtgagccaccgcacctggcccatgttggaatattttctaagaaaaaatatggaagccaagaagaaatcattccattaaagtcacaagctcttaatgtgtccagtttaaggtttcacttgagaagcaagaactggaaaagatttagggaatagaaattgcaagaatgactagggattgaaaag

SEQ ID NO: 106884 - DNA, 429 bp, Homo sapiens
ttaaggacttggctagaacctgagttttccatttctcctggtgagaatgtgtcttcaggagcttattgataattctgtctttcagcacaactttgtaaagttgaagtccctgccaattgatagtcaccttgtggcgtgatcttgtcagtccaaaagaataaagatctacctttacattcatttagagtgagggatgatgtacagccaggatgcctaagtgtcacctcctgcagttcactgacacatggagtccctttgacaggtgcccgagtttctttttcctatgtattacaacatctacttttaggattttttttttaacctctttccccctttccttcctgttctttcttccctcttttttcttctttttccatctccttggctttttaactctctcctcttttctctctttccctttccactttt

SEQ ID NO: 106885 - DNA, 264 bp, Homo sapiens
ctgtcttaggctaccgctttacgtgtgctcaggttagcacagcctctttgtccaagctgattgagactttctctactacttgcctttactgtttccctcctcctttttagcaccttgacttgctgggctcctatgtagtctgaggccaatgttttgaaatccaatgcctcttcctgaggccttctgtcatcagtatgccactgcctcctccactgaacactcacagtactttgctgttccccttcctgccctttccacggcctg

SEQ ID NO: 106886 - DNA, 539 bp, Homo sapiens
agcagagaggtaaagtcactaccctcaaggacacaccgttacccatggtgggaccaggattcaaactcagactctctacttcatgctgcagcactcctctagtggtctccatgctggagactccttgaggacaacaccagggcctgatacccagagtctggacacagagcagaggggcgtgagcagctggcagtgagcaatgccctggggcctcgggaactttgaggaaagcatgttctcaggagcatttcccctgtagccgccttgtagatgccgtcagccccttgagtctgcccccatggctgggagactcacgcactctgcccagcgtggggtctgtttgagagatgggcgttccagccatcgttgctgcatccggctaaaaccaccctgagaagcacctgagcacatgttccctgctgggtgcccccctgcattagaaatgatagaaacttaagctggctgaagcaagaaagggaactagcaggctcttgaaatcaaaaagtccaagggtgcatctacctcaggcatggctggat

SEQ ID NO: 106887 - DNA, 402 bp, Homo sapiens
catggctcactgtaacctagaactcttgggcccaagtgatcctcccacttcagtctcctgaagggctgggactctaggctcatgccactaccaccagctaatttttaaatttttttttgtagagacagggtctcatctctcgatgttgcccaagatggtcttgaactcctggcctcaagcagtccctcccacctaggcctcccaaagtgatgggattacaggagtaagccaccacacctggcctaaaggtatcctttttaaaatgaagtattttgaataataaacgaaaaagggattcatttcaaacgtacaaaataggccatctatatttttctgaaattaatacactttttggtgtagaatatctggaataccaaaaatacattttgtagcttttcccca

SEQ ID NO: 106888 - DNA, 850 bp, Homo sapiens
tgcttcgggctgtaggggacgccccaaggcagggagtcggacctgcgagcggagggatggggcgggagggcgagctgagggcagtcgcggaatccgggaaatgggagggagcccggcggggcgggggcccagggccagcccaggcgggacccgcaggcacccacctgccccggacgcctcccgagacccagccttgccgtgggggaaagtgcgcagcgggctggtcccggcgccttggactgggctccgtctctgcttcagttgcctgtctcttctcctctctctcctgcttctctctctctatgcctctctctcaagttctgggtctttcattctctcccttttcttcctttctcccttcctctccttattgctatcctttgcctctccccccggtctctctttccttccgtgcgtctgtctccctctccccaccgcctgctctggctctcccagtgtgtccctcctctgtcccttcatcctcttccctctgtcactttcgcacaatcttttggtctctctctctctctcaagaggctttcgctcccggtcttcctggctcccctgtctcttgctctctgcgcccatctctctgctcgtccctctttctgtccaggctccgtgtttccgcctgtgtttggcggtgttggagaagagcctctggaagttgtccgctgtggtgcgggtcttacttctttagagctgcacccctccagctgggtcctgctgtttgttctgaatggaaacgctgcagttcccttgagttattagaaactgctcttttcttagccacctttccagcaaggtgaggtcagtgactacgagcggccacaaaggtgccagtgaaaga

SEQ ID NO: 106889 - DNA, 466 bp, Homo sapiens
tgttacccaaagtactctctgccacacatgcaagctcattctggcaggctgagataggggaattggaagacaggggttcaagccctgccctgcacccagcagcagcaaggcagccgttcctccttctgggcccctgtaggcgatgggtagatggtttctgtgttttcatagactgccttgcgaggccttgtgggtgaagggcccaatcccagaccttggcagaggagtgacgttgaaggctggcttggcattgtttttccagagttgacgtcagggcagctggtttagggtttcatctgtgagacaaaggctgctttgtagcttctgcccggtttaagtccaagcacatcaccccccaaggtgggaaacgaggtggaagggattgcagggcccaaacagagaagccttgggaggcttggcttgcgctcagcccctccaagaagggagccaagatctcataattcta

SEQ ID NO: 106890 - DNA, 279 bp, Homo sapiens
gcagtgtagggctgagttaaggaatcctggatggatctgcaaaggagtcagagagagaaagctaggagaatgggatgtcctgagagctgagtgaagatgtattgggaagagaggattgattagtaacatcaaatgttgctgagagattaggtaaagtgagaacgcaaaagtgtctacactgttttcactgaggaggtggacttttctccagttcttgttctgtgaagggaaatcaacagaaggaaagacaagactgcttggaactagaagacagggctc

SEQ ID NO: 106891 - DNA, 1821 bp, Homo sapiens
  misc_feature (276)..(276): n is a, c, g, or t
atctggaaggcatgtttgcaatataatgtggcttgtaggatctctcctacttttttacgctctgttttgccagttctcaaaagtaaatacctgaagtcctagaggtactataaacattttggtaaacattctttgagactttttctcatgtacatgtaaatatacatcatcccaagttaaatttgataggccttcctgacagtagccatatagataaatagaagttttcgttggtttagtggcaaaactgaattcttaatgtaggtatacaagttnaatatgatggttagaaatgaagttttctgaaagtagttcgttgtatgctccctaaaagaattagctttatatttatcttaagaatatctctaaacctatgcaaaaatatggcaaatagtcttctttccattagtctagttcaacaaaatctgactcagagacagtaaagaaagggcaagtagaagatctaatgccaactaagaagataattatttctgaaatatttagttgaagataactttctttcttaagacattactgttgttatgatgcacaagtcaaagaacatgtggcatttccaaagagtattaaatgcatgttacttttttataaaaataagataaatgagattaatggggcttggaactgcaatcttggtaaataaagttactgtatgtctttcacgagtgtgtgacatgaggattgaatagacagaattgcttgttagaaagaggaactaatttttgtatctattacaaattatatttgtaattcttccctaattataaattatcatgattatttttatttgggaaataccaaaaaatcataaataactaatctaaacttacagaatcctatcatccaaaaatggccattaatgacagtttgatagatttattgcagtttttttgtatccatttatctttcttgttcattttttcttctttcctaacaaattgaagtaatgccataaattctgtttcatactttgctttatgtacccttacagcatgaacatttttcatatctttattgcccaaacataattttaatgtatattaaatagttcatcatttgaatgatctatactttatatactttatatttctcaaaataattaaattgtccaaattttggcacatttagattattcaaatttttgaacgtagggaactcactgataaatataattatacataaaccctagaccacatctctcgtgatattattagtatagattcctagaagtagagttgctatgtcaaaagtatgaagatttattttctattttcatctttaatcggattttcattataaaaaaacaaggccaggtgtggtggcttatgcctgtaatcccaacactttgggaggctgaggcaggaggatcacctgaacccaggagtttgagaacagcccacgcgacatggcaaagccttatttctataaaaaaatacaaaaattatccaggcttggtggtgcatgcctatagtctcagctactcaggaggctgaggtgggaggatcacctgagcccaggaggttgaggctgcgagtcattctatcatcccactgcacttcagcctaggtgacagaatgagaccttttctcatacatatatatatagctgcccattaaaacaaagttgcaccattttgccatctcacttcctggaagtacctacctaatactgcagacatttggtgggtgcagtagctcatgtctgtaatcctagcactttgggaggctgaggtgggcagattgctggagcccgggagattgagaccaccatggtcaacatagtgagtcctgtctctacaaaaaa

SEQ ID NO: 106892 - DNA, 1380 bp, Homo sapiens
  misc_feature (276)..(276): n is a, c, g, or t
atctggaaggcatgtttgcaatataatgtggcttgtaggatctctcctacttttttacgctctgttttgccagttctcaaaagtaaatacctgaagtcctagaggtactataaacattttggtaaacattctttgagactttttctcatgtacatgtaaatatacatcatcccaagttaaatttgataggccttcctgacagtagccatatagataaatagaagttttcgttggtttagtggcaaaactgaattcttaatgtaggtatacaagttnaatatgatggttagaaatgaagttttctgaaagtagttcgttgtatgctccctaaaagaattagctttatatttatcttaagaatatctctaaacctatgcaaaaatatggcaaatagtcttctttccattagtctagttcaacaaaatctgactcagagacagtaaagaaagggcaagtagaagatctaatgccaactaagaagataattatttctgaaatatttagttgaagataactttctttcttaagacattactgttgttatgatgcacaagtcaaagaacatgtggcatttccaaagagtattaaatgcatgttacttttttataaaaataagataaatgagattaatggggcttggaactgcaatcttggtaaataaagttactgtatgtctttcacgagtgtgtgacatgaggattgaatagacagaattgcttgttagaaagaggaactaatttttgtatctattacaaattatatttgtaattcttccctaattataaattatcatgattatttttatttgggaaataccaaaaaatcataaataactaatctaaacttacagaatcctatcatccaaaaatggccattaatgacagtttgatagatttattgcagtttttttgtatccatttatctttcttgttcattttttcttctttcctaacaaattgaagtaatgccataaattctgtttcatactttgctttatgtacccttacagcatgaacatttttcatatctttattgcccaaacataattttaatgtatattaaatagttcatcatttgaatgatctatacttttgacacagcaactctacttctaggaatctatactaataatatcacgagagatgtggtctagggtttatgtataattatatttatcagtgaagttcctacgttccaaaatttgaataatccaaatggtgccaaatttgggacatttaattaattttgagaaatataaagtatgtaaagtatagatcattcaaatgaggggcggtttattttctttaggtcgacgcggcgtcttgggaggagtagtagtcgcccgggaatccggacggtaccgggggtgttttagaatac

SEQ ID NO: 106893 - DNA, 148 bp, Homo sapiens
ccacctctgcctcccaaagtgctgggattacaggtgtgcgtcactgcacccagcctgactgtcccctttctgtttgaaacagtgttgagaaccacccttgctttaggtgcccgactcttttcagccccatggcgtggttggaggcctg

SEQ ID NO: 106894 - DNA, 406 bp, Homo sapiens
tagtagagacaggggtttcccatgttggccaggctggtctcgaactcctgtgctcaagcgatctgcacgcctcagccttccaaactgctgggattacaggcttcagtcactatacccagctgacttgtacactttaaatgaggagactgtatggtatgagaattctatctaataagcagtcactttcaaaatgttgcttatactgcaagtttaccttttaatacagtcatgcacagtataatgacatttcagtcaatatatatgaactgcacatatatgacagtgttcccatgagattacagtagaactaaaaaatgcttatctcttagtgacactgttgccatcaggacatcatagcacaacacattactctcgtttgtggcaatgcttgtgtaaatctaactgt

SEQ ID NO: 106895 - DNA, 398 bp, Homo sapiens
ggaccagggagatttgattgagtctggtttccaggtgaattaaaaggaagggtgtcatccagggtttgttactacagtcaaaagaataaataaatcaatgaagaaataccttcattgtctgtggttttcatgcagatatactcatggaggttgtatctctccaaaaacagacaaatccaaggctgtgaacaagcatccgcatttgaattccattaaaccaaaatctatgttgaacgaagtgaagtctgtacacagcattgcaaatgtgaacacattcctgtgtgaggcacatcaccatttgtcagttattgtgaatatgtgtatttttaagcaataagatgcagctggtcagttttctgggcaatcttggtgaggcatttcctgtgctgtggttgttc

SEQ ID NO: 106896 - DNA, 326 bp, Homo sapiens
aaattaatgagaaaaacaggctattgtttgtcttttcatttaataactcagttggctcagtgccctggctcacacctgcaatcccagaactttggtaggctgaggctggtggatcactggagccaagtagttcaagaccagcctgggcaacatagcatgactctttctaccaaaaaacaaaaaaaattaactgggtttggtgacatgtgcttgtagtcctagcaactcaggaggactgatgggacgaatccttgagcccagaaatttgaggttacagtgagctatgatcacaccactcaagcctgggtgactgagaccatgtcact

SEQ ID NO: 106897 - DNA, 5905 bp, Homo sapiens
gggaagagatttaggctaggtacgaaggcggggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcacttgagggtcaggagttcaagaccagcctggccaacatggtgaaacctgcctctactgaaaaatacagaaaaattagccaggattgtggtgtgcgcctgtaatcccagctattcaggaagctgaggcaggagaattgcttgaaccagggaggcggaggttgcagtgagacgagatcacgccactgcactgcagcctaggcgacagaggaagactccagctcaagaaaaaaaacaatggactgcccctaatttgtaaaccatttaaatgtgtctattacatttaacttttcttaatgtttgtcaactaaaagttttattcattatactttgacatactggaacacaaaacttgattcctttgaaaaactaaagagaagttgataaaaaaaatacagaagctctagattcctaattggaactgactacactcatttttaaaaaatggacgatgcctaataaa

SEQ ID NO: 106898 - DNA, 5655 bp, Homo sapiens
gggaagagatttaggctaggtacgaaggcggggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcaagaactgtaggcagtgacacatttttgtcattaattcttgacaatcacatacaccgtaaacctacaggaattccaagaactagaggtctgaggactctgaatcttctgcaagttacatatgatttaagagaaaaagaatcaaccctgtataccttagaaatgaggttacagtattgacttcaagaatataaggctcctactgagtctaaa

SEQ ID NO: 106899 - DNA, 5420 bp, Homo sapiens
gagcctgcgtctcttctcttacaggcatgacagcaagcgctgtggcggctttgatcctcatgacgtcctccatcatgtcggtcgtggggtccctgtacctggcctacattctcatcatctgcatcgtcacgtacgtgctgaacttccttcttctcattatcaactacaaacgactagtttacttgaacgagctgcaacccaagcaggactgacgcccgacagactccaccctaacagtctcaagcccctttccattcagtttattttgcagcagattattattattcacaacagacactttccctaagaatctcaaactgatttttaaaaatccggtaaattagaaggggccctcgctattttctaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcacttgagggtcaggagttcaagaccagcctggccaacatggtgaaacctgcctctactgaaaaatacagaaaaattagccaggattgtggtgtgcgcctgtaatcccagctattcaggaagctgaggcaggagaattgcttgaaccagggaggcggaggttgcagtgagacgagatcacgccactgcactgcagcctaggcgacagaggaagactccagctcaagaaaaaaaacaatggactgcccctaatttgtaaaccatttaaatgtgtctattacatttaacttttcttaatgtttgtcaactaaaagttttattcattatactttgacatactggaacacaaaacttgattcctttgaaaaactaaagagaagttgataaaaaaaatacagaagctctagattcctaattggaactgactacactcatttttaaaaaatggacgatgcctaataaa

SEQ ID NO: 106900 - DNA, 5100 bp, Homo sapiens
gggaagagatttaggctaggtacgaaggcggggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttaccctcgtgccgaattcggcacgagaagaatatgagttttgaaaccagacactctatatttggattccagctcaatcactttgtaaagaccttcagcaagtcctttaattctctgagccttagtggcttcatgtataatctgggaataataacacttgccttacaggtttggctcaagatactgcaggcacttgttcgggg

SEQ ID NO: 106901 - DNA, 4826 bp, Homo sapiens
gggaagagatttaggctaggtacgaaggcggggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtccctgtacctggcctacattctgtactttgtgctgaaggagttctgtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcacttgagggtcaggagttcaagaccagcctggccaacatggtgaaacctgcctctactgaaaaatacagaaaaattagccaggattgtggtgtgcgcctgtaatcccagctattcaggaagctgaggcaggagaattgcttgaaccagggaggcggaggttgcagtgagacgagatcacgccactgcactgcagcctaggcgacagaggaagactccagctcaagaaaaaaaacaatggactgcccctaatttgtaaaccatttaaatgtgtctattacatttaacttttcttaatgtttgtcaactaaaagttttattcattatactttgacatactggaacacaaaacttgattcctttgaaaaactaaagagaagttgataaaaaaaatacagaagctctagattcctaattggaactgactacactcatttttaaaaaatggacgatgcctaataaa

SEQ ID NO: 106902 - DNA, 3871 bp, Homo sapiens
atatcataagtagggccgggtgttaatcggccgagtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcacttgagggtcaggagttcaagaccagcctggccaacatggtgaaacctgcctctactgaaaaatacagaaaaattagccaggattgtggtgtgcgcctgtaatcccagctattcaggaagctgaggcaggagaattgcttgaaccagggaggcggaggttgcagtgagacgagatcacgccactgcactgcagcctaggcgacagaggaagactccagctcaagaaaaaaaacaatggactgcccctaatttgtaaaccatttaaatgtgtctattacatttaacttttcttaatgtttgtcaactaaaagttttattcattatactttgacatactggaacacaaaacttgattcctttgaaaaactaaagagaagttgataaaaaaaatacagaagctctagattcctaattggaactgactacactcatttttaaaaaatggacgatgcctaataaa

SEQ ID NO: 106903 - DNA, 2401 bp, Homo sapiens
  misc_feature (35)..(36): n is a, c, g, or t
gcgaaattccggcacggaaggaactatttttcatnntccaaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcgtgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcacttgagggtcaggagttcaagaccagcctggccaacatggtgaaacctgcctctactgaaaaatacagaaaaattagccaggattgtggtgtgcgcctgtaatcccagctattcaggaagctgaggcaggagaattgcttgaaccagggaggcggaggttgcagtgagacgagatcacgccactgcactgcagcctaggcgacagaggaagactccagctcaagaaaaaaaacaatggactgcccctaatttgtaaaccatttaaatgtgtctattacatttaacttttcttaatgtttgtcaactaaaagttttattcattatactttgacatactggaacacaaaacttgattcctttgaaaaactaaagagaagttgataaaaaaaatacagaagctctagattcctaattggaactgactacactcatttttaaaaaatggacgatgcctaataaa

SEQ ID NO: 106904 - DNA, 2462 bp, Homo sapiens
  misc_feature (2462)..(2462): n is a, c, g, or t
gggaagagatttaggctaggtacgaaggcggggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcagaaaaaaaaaaaatggcctcgttggcaacagcggtggagctttgcgccaaan

SEQ ID NO: 106905 - DNA, 2354 bp, Homo sapiens
gggaagagatttaggctaggtacgaaggcggggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagcaaattcaacacccaacagcttccttaatagcaaaggtagcaacagcccaggatgatataactggtgatggtacgacttccaacgtcctaatcattggagagctgctgaaacaggcggatctctacatttctgaaggccttcatcccagaataatcactgaaggatttgaagctgtgaaggaaaaggcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacgagagaagtgaattctggctttttttacaagagtgcagaaagagaaaaactcataaaagctgaaagaaaattcattgaagatagagttaaaacaaataatagaactgaaaaggaaagtctgtggtgattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgggacatgcaggacttgtatatgagtatacattgggagaagttcacctttattgagaagtgtaacaaccctcgttctatcacattattgatcaaaggaccaaataagcccacacttagatcaaagatgcagtaagggatggcttgagggctgtcaaaaatgctgttgatgatggctgtgtggttccgggtgctggtgctgtggaagtggcaatggcagaagccctgaataaatataagctcagtgtaaagggcaaggcacagcttggagtccaagcatttgctgatgcgttgctcgttattcccaaggtgagcccgtggtagcagcagaagcaggcattatgggataacgattgtgtaaagaaacagcttcttcattcctgcactgattgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgtggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaatttctgagtaaatttattgatcagttggacttttcacgcttttgaaatagctttgctaaaatgctccccctacaaagttgtaggaaatgggaagaggagtaaactagaggcaagggagttgagagagctggaaggcatggtggctaagggctacggttatcaggtgaaatttgagatttgtaggctgactatattttcaagcttctgaacttttgcttatgcaaaatattcatcccaaagcctctagcgtcatagtttcctcacccaaattactatgtttccacaagatttatatagttggtctatctctgcggtccttgaaagtgaagttggtgttactaggctgtgggttttgggggctcagcagtgacctggagtgtgcaaataaatgttaagttgaaacctc

SEQ ID NO: 106906 - DNA, 1340 bp, Homo sapiens
gccagtgaagccattctggttggaccattctcctatttgatatgttagtcgcttgtattgtggctttcacatgcagtacttaaattgatgtggtcatagtgaatttgtaagaaattaatggctttcatatgtatattttgttattcataattagttctacagttttcttagcatttttctttttcccccatccaacaggctgtgtggttccgggtgctggtgctgtggaagtggcaatggcagaagccctgaataaatataagctcagtgtaaagggcaaggcacagcttggagtccaagcatttgctgatgcgttgctcgttattcccaaggtgagcccgtggtagcagcagaagcaggcattatgggataacgattgtgtaaagaaacagcttcttcattcctgcactgattgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgtggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaatttctgagtaaatttattgatcagttggacttttcacgcttttgaaatagctttgctaaaatgctccccctacaaagttgtaggaaatgggaagaggagtaaactagaggcaagggagttgagagagctggaaggcatggtggctaagggctacggttatcaggtgaaatttgagatttgtaggctgactatattttcaagcttctgaacttttgcttatgcaaaatattcatcccaaagcctctagcgtcatagtttcctcacccaaattactatgtttccacaagatttatatagttggtctatctctgcggtccttgaaagtgaagttggtgttactaggctgtgggttttgggggctcagcagtgacctggagtgtgcaaataaatgttaagttgaaacctc

SEQ ID NO: 106907 - DNA, 1758 bp, Homo sapiens
gcctcagcctcccgagtagctgggactacaggcacctgccaccacgcctggctaattttttgtatttttagttgagatggggtttcaccgtgttagccaggatggtctcgatctcctgacctcgtgatctgcccgcctcagcctcccaaaatgctgggattacaggcgtgaagcaccgcacccggccaccttactcagtttttaatcaagtactatgataagaaaatagattgggtgattatattcatgggtgaaaaacagctaaagatagcaaataatgccagaagaggggatctagaaatctaatgaaatggtgacagccctgatcttaggcccctgtaacaaaacaacacaaattaagtacaaagtaggagacagataacaggtacatccatgcagtatgtgcaagacctattgctgtcaacattattatttaataaaaaagatttctggaatgagggaaatgatcagtccattttagccagattagagttgcagtgctgtactttagtatgggtaaacagaaatgtatccagaaggagagaggggtgttcaggtcttctaagtagaagtcagacactcctcaaatattgtggacaggggtcatggtttagagtagaaaattgggctaacagagaagctttgaattcccatagttaatactggaggaaatgagtcatcggtgataagcaaagccacacacagtattgttggttcttattgactgaacttactttggttgccttttaggtgagcccgtggtagcagcagaagcaggcattatgggataacgattgtgtaaagaaacagcttcttcattcctgcactgattgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgtggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaatttctgagtaaatttattgatcagttggacttttcacgcttttgaaatagctttgctaaaatgctccccctacaaagttgtaggaaatgggaagaggagtaaactagaggcaagggagttgagagagctggaaggcatggtggctaagggctacggttatcaggtgaaatttgagatttgtaggctgactatattttcaagcttctgaacttttgcttatgcaaaatattcatcccaaagcctctagcgtcatagtttcctcacccaaattactatgtttccacaagatttatatagttggtctatctctgcggtccttgaaagtgaagttggtgttactaggctgtgggttttgggggctcagcagtgacctggagtgtgcaaataaatgttaagttgaaacctc

SEQ ID NO: 106908 - DNA, 2482 bp, Homo sapiens
gggaagagatttaggctaggtacgaaggcggggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagcaaattcaacacccaacagcttccttaatagcaaaggtagcaacagcccaggatgatataactggtgatggtacgacttccaacgtcctaatcattggagagctgctgaaacaggcggatctctacatttctgaaggccttcatcccagaataatcactgaaggatttgaagctgtgaaggaaaaggcccttcattttttggaagaagtcaaagtaagcagagagatggacaaggaaacacttaaagatgtggccagggcatctctttgtactaaagttcatgctgaacttgcagatgtcttaacagaggctgtagtgggctccattttggccattaaaagaaaagatgaacctattgatctcttcatgattttgtgatcattgacaagaaacataaatctgaaactgatacgagagaagtgaattctggctttttttacaagagtgcagaaagagaaaaactcataaaagctgaaagaaaattcattgaagatagagttaaaacaaataatagaactgaaaaggaaagtctgtggtgattcagataaaggatttgttattaatcaaaagggaattgaccccttttccttagatgctctttcaaagaaggcatagtcgctcttcacagagctaaaaggaggaatatggagaggctgactcttgcttgtggtggggtggccctgaattcttttgaggacctaagtcctgactgcttgggacatgcaggacttgtatatgagtatacattgggagaagttcacctttattgagaagtgtaacaaccctcgttctatcacattattgatcaaaggaccaaataagcccacacttagatcaaagatgcagtaagggatggcttgagggctgtcaaaaatgctgttgatgatggctgtgtggttccgggtgctggtgctgtggaagtggcaatggcagaagccctgaataaatataagctcagtgtaaagggcaaggcacagcttggagtccaagcatttgctgatgcgttgctcgttattcccaaggtgagcccgtggtagcagcagaagcaggcattatgggataacgattgtgtaaagaaacagcttcttcattcctgcactgattgccaccaacattctcttggttgatgagatcatgcgagctggaatcttctctgaaaggttgaattgaagcttcctctgtatctgagtcttgaagactctgcaaagtgatcctgaagaatacagctgtggaatttttgtccaagcttcaaatgagtttcaagggaattttcccatgtgaaaaaaggagagaacactggcatctgtggaagttctgaaattataattacagtattttttaaaaattgcactgaagtgtacacagataaagcaggtctttcacccagtgaacaggatgttttgctttagcagcagtgacataaaattccatgttaaataagcatatattacctaccttattaaatattccttgaaaaagcagattttaatggtttaattttatgtggacatatgttaaattattcagcagtaccctattgttaagcatctggttttaaaatttttatgctaatataaataacgcttagtaatttaaaattttggaagcatcccgttagtgtaaatttctgagtaaatttattgatcagttggacttttcacgcttttgaaatagctttgctaaaatgctccccctacaaagttgtaggaaatgggaagaggagtaaactagaggcaagggagttgagagagctggaaggcatggtggctaagggctacggttatcaggtgaaatttgagatttgtaggctgactatattttcaagcttctgaacttttgcttatgcaaaatattcatcccaaagcctctagcgtcatagtttcctcacccaaattactatgtttccacaagatttatatagttggtctatctctgcggtccttgaaagtgaagttggtgttactaggctgtgggttttgggggctcagcagtgacctggagtgtgcaaataaatgttaagttgaaacctcctttgtggtcttgcaatggtttgacacacagaagcaatcttaaagggaatgaaagctgtccaaaggttcaaaaagtagtgaaggggcctctagggaccctcaacctgcttttccttacttccctgggc

SEQ ID NO: 106909 - DNA, 421 bp, Homo sapiens
tttgaaagatgactggagataaaacaacctgctttataatgtaatgatcttgtttctagaaatgatcacttagaattcataagaaaataattcaaaattctaatgtgtgttatagtttatcactgctaagtatccttctacttctgagactatacagttgcataaacttccatgttagatgtgatctttgagataatgtattttacacccgcaacattatgtttgaaaaatataaaggcctagagactgttttgtgcaagtatcattgtctgtgataaaattatttcatgaattctcagcttggatctgagtattcattctacagcacaagaagtcagctttattcttagggaaaacaacatattcacacaattttatttttagctttgataaataaaatttttgttttccttttattcag

SEQ ID NO: 106910 - DNA, 489 bp, Homo sapiens
aactgcactctgcgatatctacattaaaatacatcaagcacttccgaatatctaaagactagatatttcatagcttgtccaccgtgtacacggcactgttaaataaaactgcacacacataacaatggttatcatctaaggtatcttctaaatgtgaccattttggccttgaatcattccctcttctcttccttctctgccttcaattcagtggacaagtacacgcatgtgtaatgcttagagatggctgaacaaattcctatgcaaaagtcaattacagaagacaagttttcctatgaatttcaacacaaagcatacaaaatatgctaattttactactttgtcatacactggcaacctctagatgttaaaaaattaagactatttgtccattaatacacaataacaagaaatcaaaatatatgggcaaaaatgcaggtaggatgtaggatgtggttttgggagcttgtgaaattctcttctaattgc

SEQ ID NO: 106911 - DNA, 871 bp, Homo sapiens
cctcagactcctgactagctgggactacaggtgcctgtcaccacagccggctaatttttgtacttttagtagagatggagttgcaccatgttggccaggctggtcttgaactcctgtcctcaggtgatccacccgtctcagcctcccaaagtgctgggattacaggcgtgagccaccgcatccggcctcagccaccatcttaattacatgtctgaaggaatgacattttatatttggccatgagtgaggtggatttccctgaactttagccttgacaatttgatgacagttagggatatccttacagccctaagagggccattgaccctgaacagtacaactgggagctggccaacctcagcgtttgtcacccgtgatcaagtctttctgcttagcacacactgtggttttcagtagcatcttttgttgaatgctattcagatcctgaattattcataaaggattcccacgttcagaaggagtgtggaccagatgaccttgttggggctcggaaaacgatgacccaaagtgtagcactttggcatgctgagtactttgaactgaaggactttggaagggcctcaaaggctgtctctttctgaccctctcctgctcttctttttcttccttcccttttccccaagacaggccacagaaagtagaatccctcttcaaggcaggccatagaaactagaacccaacttctccaataccagccacaaaaacctaggtatataactctaacctatcaccacctttctgtgtaagagctggttataaataaattctctggaggtggaggatcagttgaggccaagagttcaagaccagcctgggcaacatagtgagatctagctctgaaagaaagaaa

SEQ ID NO: 106912 - DNA, 447 bp, Homo sapiens
gcttgcagacagccttttgtggcacttcaccttgtgactgtgtgagtcaattctaataaaatcctcttcatatattcatctatcctgttagttgtgtccctttagagaacactgactaatacagtgaagatgaaggaaaaactctgggtaatgcttcttcttcatggcaaggaatgtcaaaaatggtcaataaaccaccagatactagggaagaggcatgggtaagatcactctcaccgcattcagagcgaatcaaccctgctgatgccttgatctcagattttgagcctccaaacctgtgagacaatatattcctattgtttaagccacccactcaattagcaatactttgttcaggctgctctaacaaactaagacaagctttaatggagtctacaagtttgttgagacatgtttaagtcccatgcactaggacactgatattct

SEQ ID NO: 106913 - DNA, 383 bp, Homo sapiens
agactctaagtagctggaaggcaggggagtgtctgtttttaaagccccctgctgaatcctgggcagttagggtgggacctggctcatgctggaagttcaataatgagttcttagatgagggtgtccagtatagggaaccacctgtgtacctgttcttcccttcctctcccatctcccttgcaactccgtcaatcgcaaggctgccatcacacatcacagactggagggctcaaacagggatacatttcctaccagttctctaggctgcaagtccaagatcaaggcgtcagcagggttggtttcctctaagcctctctctttggcttgtagatggtcatcttctccctacatcttcatgttgacttctctctgtgcatatgtct

SEQ ID NO: 106914 - DNA, 218 bp, Homo sapiens
cagcatctgctcagtttctgttgaggcttcaggaagtttttcctcatggcagaggtgaagaaggagcagatgtgtcacacagagagggagcaagagagaggggaggaggtaccaggctcttttaaagaaccagctctcgcatgaactcatagagcaaggactcactcgttaccatggggagggcaccaagccattcattaaggatccacctccatgac

SEQ ID NO: 106915 - DNA, 342 bp, Homo sapiens
tcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaa

SEQ ID NO: 106916 - DNA, 203 bp, Homo sapiens
ttcccttggcctaccccatgtgctaagcccatcccgcaaccaagccctccctgctctccctacagcctgcgtagacaccgctcctcagatgccctcagcatccctcaccttccctgaaaccttgtctgagagactggggcaaaatctttccttggagttctgctgcccccagatccacccgccaacactggaggcaggcaggg

SEQ ID NO: 106917 - DNA, 341 bp, Homo sapiens
ggctggagtgcagtggcgctatcttggctcactgcaacctctgtctcccgggttcaagtgattctccagcctcagcctcccaagtagctgggattacaggtgcataccaccatgcccgactaatttttgtatttttagtagagacaggctttcaccatgatggccaggctagtcttgaactcctgacctcaagcccgcgtcagcagattactggcgtgagccaccgcccagcctcttttcagttgtttttctgaaacattgtgtgtgtttgtgtgtgagtatgtgcacttctgtatctgtctgtgagttttcttttgttcctcttggtaggtgagacattc

SEQ ID NO: 106918 - DNA, 249 bp, Homo sapiens
cttgtgatccacaccaatagcttctgagacgattttcagcggactccctcaccgagtttccttctctttcattttattttttcctcctcggtttctgtttccatctcctctgtgaccattgtgtgctccagccccaagattcttcttcagaggatccagggcgtgaggagcaggatccgtcagtgaaaaacacgaaacaaaacagaaagctcttccagggtgtgttgaggatcagcaagacccagaaat

SEQ ID NO: 106919 - DNA, 611 bp, Homo sapiens
gagccagggatggggcagggggcccagactcccagtcacacccaagcaagtgggacaagtaccagaggtgactcatatgtagaggtaaaaagcacaacaccgctgctgtctgtcctttggggtcctgtagccgtcggccatgagagggggctgcagtgccaccaacccctgggtctgtatgccttggtctcccacttacagacccagatgggtcgaattcctccgtctccataatcacactaaggaatgcggtacataccgagcatgcactgcaggtgctttgtccttaactcactgaatcctccagcaaccctacgaagtcaggactaatgtccccactttccagatggggtggcagaggctcagggaggggatgtgacttccccaaggtcacacagcgggatccatagccagcagctcttggttaatatgacttacggtgtccaaagccccctccccatgtgcctcccccgaccctcagctggtgggactgagaagccagggccgcactgctctctgcggaccctgcaggactctccttctcccctggcttcctttgcgccacaccgaggggactggatggtgtgatgcttttcccacgctggatttgg

SEQ ID NO: 106920 - DNA, 434 bp, Homo sapiens
tctaattattctgtaatgaatatatattactctggtactaagaagaaaatatttaaaatgaaaaacagaaaggaaaagtctaaaccaaagggcccggagtggtggctcacacctgtaatcccagtattctgggaggctgaggcgggcagatcacttgaggccaggggttcgagaccagcctggccaacatggcgaaaccccatctctatttataaataatttttttttaaaaaagagtctaagccaaaggttgacaaactatagctcatagaccaaatgtagttcatcatgttttcctatgaccatgagctaagattggttttacatattaaatggttaaaaaaattcacaagaagaataatgttatgtgacacatagaaactacataaaattcaaattttactgtgcataaataaaattttatgggaacacag

SEQ ID NO: 106921 - DNA, 419 bp, Homo sapiens
ggacagatgagatggacagcagtgttttagtcacgtagactcacagtcccagggagaagggcacagcatgtcatgcagggttacatgggggtgtccttgaaacagagtggataagcagcagctgtggaaagcaggctttgtagtttcaagagggtgcttgtcctttttcattccctgggaaaaatgtgattgcctcatttgatctatggtctgacagaaaactgaaatcttctgtgctcagggataagcaggaacttcacctggtcctgttgataaggagagttgtttggttaggagactttacccacatgagcggaggagaggaagttgtggctacgccatttgagacccttctgatttcaacagatgttaaagcatcacttagtattggacttagatgttaaactttacttcacaac

SEQ ID NO: 106922 - DNA, 347 bp, Homo sapiens
atgtaaacaattttaggctacaatgaagtgattttgcctgagtaacctagaaaatcatttgtgtttcctcttgaaccatgatactagaaaacactattgagaaatattactttgtgtgtagtatgaatggctttacatgtagcaaatataagcaaataaaggaatacagatttttatgctagcaaagttcctgtctaggctgttgaagtttctgtttataataaccctgccttttaaattaatcattctcaaagttattcatataaaatgttcaaaacacactttttaactttacactaaatcttatgtctatgtcctttacaattgattcctttttttgataaatt

SEQ ID NO: 106923 - DNA, 345 bp, Homo sapiens
tggttcctaaatcagctgcagagcaacaagagccaagaccagctctctgcaaacccagagtgaagtgacttggtctggggagctcaaacacttttagcacaaaagttccacaagacaacgaaggtaagtacactactggggaaagaaagagaagcaccgtaattagcttgacaacagaagatctcaaatcttcatcagtgtaagggttcactgaggcataaataaacattagcacaattgatatgtgtcttttatttttccatataaaccaatggttctcaggcttttgggataacagactcacaccctccttctttgagaacctgatgtaagtttccttctaga

SEQ ID NO: 106924 - DNA, 478 bp, Homo sapiens
tggaagaaaagggtcttactctgccacccaggctggagtgcagtggggcgatcatagttgattacagcctcgacctcctggggtcaagcaattttcctgcctcagcctcctgagtagctgggactacaggcccacacaccactcctaatatttatatttgctttttgtagaggtggggtttcaccatgttgcccaggctagtcatgaactcctgggctctagcaatcctcctatctaggcctccaaatgtgctgtgactgcaattgtgatttactgctcccgctttatgtgaatttcagacatccttaccagtactaacaattttctctactttaccatgcttcaaaccaatattagctgtgattgaatgggtaaaccaaacttaattcaaaggtttagtattgtagggcttactttcaagtaataaagatttggggctcccattgttaactttgtttcatttctgaaattgttgaaa

SEQ ID NO: 106925 - DNA, 1903 bp, Homo sapiens
gaccagaaaaagcatagaaaaattagatccacacacagcacccaaaaaaggccatagtcttttgtttacctagatgtattttaacctctttaccactaagcattttactataatagaactggggacatacattgtccttttgagtccgttgaatctgcaccatctaccttttggctgattcaccatacaggtggcaaaggcctttaaaaatggggagctaatacgtagggcacattctggtagggccaaaatattcagtgtctggggggtgctatgcaaatatcaatgactttttactaaaaacagtggatttcctcatttctttaagatccaagtagaaaatgtaaataacttacattctgtatgcaggactcaatacagacttagtcaatctgattttttttggtgcttttcagtatagcgcaactctaaaaggaaacccattcaccctccttagtcctttgaagtatacttttgaaattataccttattgttaatggcaacctaatcaagctaggatttgtcggttaaaattttgattcttgtaatctgtactgtcaatttttggccactctggctgttacagcaaacttttctcccactgtcataattggtctaaagtagtatttgtttcaggactatccaaaaagcaaggccagcacattgagaagatgcagaatcctactctattacaaacctcactcatgtttcttttattgaaacctttttctactttatatttcctcttttgtaaatttttccatgtcatttaaaaaattttttactttagaattacagattagttctttttttaaagcattatggcattttcaaaaaaaaaattattttggttacccaaaaagctatacaagaaatataacttcaattttttaggttgatatgggtatatttttaaagtttttattactttatacaaatacaaattaatttatattatagtttaacacctgctatgatgatagatatcacactgctatgatagaaaatccctgtctgtcattgaactattcatttagtgttactctgatatgttaataatgtattccttctaatgaagtccttgtaacaagaaaccctgtgagattggtataatgagatatcaaataatcagaagtataattaaaatagaacatgttggaaaatcccaacatttcctgttatgccgtcatacctccggtgttcagtttgttactcaaaagttcccagttcttaggctgaaaaacattcaagtaaaaatgtagcatagattacactgaaatattttcagtatcaatgatttaatatccacacaaactattaggaatggtatctggaacttgttacaaggtcagataaactgttacagaattttagaaataattatctctgtatgtgactgtgtattacatataaaaatgaatttttcaggaaaagtgcactttaaaaatactttctcttgctagttttttaaattgatgaaatagcctgtgctgctttggaatgcttattctttctttgatgaaaatacggtcattgattatgataattttaaaaatatctatttctgcatcgctgcaggatttcctacacttttctgttcctcatccctcttttatgtgtgcttggctcagttgcctgttacacagcctctgccttggttttgtgtattctaagataatttataaacacagatatttacagtgaagttcttccttttgaaactaatcttattcttttattcctctctctaaaaattggttggccatgctcactaatgattttttttcttaacaataagcatttcttggtattggtagatttggattgcatggtaagatgactgcccattttcaccatgtatacctttgtcaaataaagatttctgatctttggtctgcttctg

SEQ ID NO: 106926 - DNA, 410 bp, Homo sapiens
tgtagagatggagtctcactatgttgtccaggctggtcttgaactcctggcttcaagtaatcctcctgcctcagcctccctaaatgctgggattacaggcatgagcacttgcactcgacctacttataatgtttttaatccttgcaatggctctacatgggttatcatgcatgttttatagatacagaaacaaatgcagaggtggtgatatgatcaaggttcacacagttaacaaactgtagtgaggattcaactcatcaccaaagccctcattttttcttctccatcaagttaagagctgaatagtcctatattgtacaggaagggagaggagatcttagagaagttgcgagggaatttgcttttgattgagatcattgctatccctgggatcagaatgcagagcactc

SEQ ID NO: 106927 - DNA, 396 bp, Homo sapiens
aacccggcggtgctcccgagcgctgtctccggcttgaggcccggttctgatgcagcctcttgactctgggcatttcctatgtgtctgtttcctcatcgctgaaatgggcatagtaaaagcacccatcccacaggggcatgagggcatctgaaggttgcaggtagaggaagcggtgccccaagtgccgacgggcccaccccggggctcggtgtgtgctcaggatgggggtcaggacaggtgcagcctggcacacaggaggcgctccccaggagcccaggggcgtccttgttccacagcccctgcttctgctgtgatgatggttcttccacagccggaaagtctaagggtactgacgctgaggtggaagggattgtgaactcagatgctggtagtcga

SEQ ID NO: 106928 - DNA, 444 bp, Homo sapiens
aaggtgaggactcagggaagctccaaggttaagtgctaggtcctctgggggctccatgccacagtttgctgtcactggagcctgccgagggatccaatggggacagagcaggcagtgagcctcttagtgtttctaatgcagcccgtggccatctcagacacctgtcactagagtctatggtcttcagactcacactggtcacacgctctcagatgtttgacccccacacatgagtgccctttggcttgtctatgtgtcctgtgggtgctcgtgtgctctgtgtgtcctcgtgcatgcacaaacatgcacatccttttctattcttgtgcacgcacaagcccatgtactcagctgtgatcatatccacacgagcaagtgtacccatgcccttgcacatgtgtataccaggtatgtgcacccagaggtgtgcatccactcctgtgc

SEQ ID NO: 106929 - DNA, 867 bp, Homo sapiens
ctcaaattttgctgccttttctaaccttttcccagaaatttatttaaatccctggagattccttgtccattactgaatagcctttgggagaagctctctgaatggaagaggtatgttgatcagtgatgccattgggacctgaaaacagtgaaggctctaaaatagccaccacggccaggcacggtggctcacgcctgtaatcccagcactttgggaggacgagacaggcggatcacgaggccaggagatcaagaacatcctggctaacatggtgaaaccccgtctctactaaaaatacaaaaaaattagccaggcgtggtggcgggtgcctgtagtcccagcaacttgggaggctgaggcaggagaatggtgtgaacccggaaggcggatctctcattgagccgaggtcgcaccacttgcactccagcctgggcaacagagcaagactccatctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggaaaaaaaaataccggggggggaaaaatgatagaaccacccactgtgttataaataaaggagggacgcgcctatgatgacggaaacattataataaagacgagagggaggatgtataaaaaaagtagtgggggaaagaaactggtgtggaggtatatgtgaaaaagacaaccacatgtggggggagaataagtggggaacaacatcagtaataatagtaagggcagagagaaaaaaatgtgggttgagtgagaaaccagagatatgttggggaaaaatgccaagattattggaaattag

SEQ ID NO: 106930 - DNA, 596 bp, Homo sapiens
caaacatggatcctttacatcatcaaaagaatatacaactcaaacatactgctacattactagaatcccattcagtcattagtaattagtccagttcattatcatgttgtatgaatatgtctcccagggagagaccactcaagtttgcaggcttcctttcagtcttgtcagattccagaagcaggagcagtctccgcaaacatacaacttttaccttttgagcatctcttataactgagttaaagacagtgtcatctcttgctctgagcttctttaaatgtgttaatgtaatgttggatttccctcaatgaataacccatttattcctgtctttaccctcagctgctattcctcctctccagtagttcccaaacttttcctcctttggaaggcacattaagaattgccactgtgctggtttagattgcagacaacaactctagtctagcaagtacctcctcctcagtccactcccctttagatagggtaaattacatgggtgcagaactagtgagctgtttttatggccaggaaaagtagtagttgcattcactcttagccccaattttgctagatagagtgaaggtacaacccac

SEQ ID NO: 106931 - DNA, 364 bp, Homo sapiens
cctatactccaaagatgggttgtataagtctgattaatatctaccgtgttaataaagtcttaaagcagatagtgacttcttaaatttaagatttaggatatcaaacctagcatcatggatacccttatccatttaaaataaaaagataacccaaggaaacatttttgattcacaatggttttaatgaaagatgtaaaggaaagagtgtagcaattaaagcagaatggcttttgctcttcaagttccatagtcaatttgtaattgtttttcaacccaaacttccttctacatcatcatgttttccatatggcataatgttgcctattgttggaatctcatctaaattgaaaaacctagacttttg

SEQ ID NO: 106932 - DNA, 242 bp, Homo sapiens
ttgttagaggcggaaggggaggatgttgggttgtaactgccctaacccctgtgcttctctcaggcctgggatcctgcccaagcaaaagtggtccttaggagagcggctcctgggttacagagtaggcgcaatctctgactggtggtggagtggaggggagggttaaatagtacaacagggcagtgggtaggacagcccggagtctcctagaccctccctccaaatccagggggattttgctg

SEQ ID NO: 106933 - DNA, 489 bp, Homo sapiens
tagagacagggtcttgctctgttgcccaggctggagtgcagtggcgcaatcatggctcactgcagcctcaaactcctgggctcaagcaatcctactgcctcggactcccgagtagctgggactacaggcatgcgccaccacacctggctagttttttattattttgtagagatggggtcttgttttcttgcccaggccactttcaaatgcctgggctcaagtgatccttcttcctcgacctcccaaagtgctgggaatacaggcatgagccaccactccaggtctctcttttatatagtgtggtggatgttgactttatacttaaaatttttttaaaacatatggcaaatattataaggtgtttgtgccccacacccctgccaccaaattcctgtgttgaaatccaatccccaatgtgatggtatttggaggtggggcctttgggtggtaattaggtcatgagggtggagccctgatgaatgggattag

SEQ ID NO: 106934 - DNA, 620 bp, Homo sapiens
acaagctatgcgaccttgagcaaatcatttaatctctttgtacttcagtttcttcatctgtaaaatctggatacttagctcataaagtagtgatgattaaataagttagtatatgtaaagtgtagcgttggtaaagtgcttagaatgctgcctggcctacagtaagcagcatgtgtgtgtgtgagtaatgtcactactaggagtagtcatgtggactctaatactgctccggctactacttcaaagatgtaaatgttctggggtcagtctccccaggtaccccctcattgcctcctctgtcacatttcttagtcttggccacttccttaagagtgcccatgacacttcctttcagtccctcagttcctgatcattttctccgttctccatttgttttggaatgctcagctagctgatgcccgagaaggcagctgggttggtaattacacttctctgcttgctctcaccactatttcttctcaagaaagctcttgtggctgagggaaatcgctcttaaaggttggggagaccttgaaaagaattctgaagtggttgggagaggagtgtgagctaagtttgcagagctgagctagccagcaaagtcgggttctcagtgggga

SEQ ID NO: 106935 - DNA, 436 bp, Homo sapiens
cggttaatttgtggcagaggactagatgtgagtctagtgcttaccagttctattataaattatttcaagtactatttaaattgaataattaaatctttatacaactttagtattctgttttatattgtctttgaaaataaatgtcctttgctcagtgctgagataagaactaatattaacctattgtttcacagtttgaataactttttacatgtaatatgatcctcacaaccctaggagtaggaaaaacagaattttatcactattcctattttagatataaaatcttacagtaatatcacacagccaacaagttgcagagccagaattcaaaagtagattttctcacataagatttgaaattggactcacttaagtgagctagttcagccagtctggatcagagaagccagcttcttggttgtagtgatggtga

SEQ ID NO: 106936 - DNA, 357 bp, Homo sapiens
ttggccaatacaagttgcttgctccttatgttttggactcagccacctcaggaagcctcaagtctggccatgatagtaattttccctagattatctcccacaaaattctattctcaagcagatgtaagatctataataaatacctatgaaattgctgtgaaagaaactagagtaatcaaccattgcattttttatgtgaagttttgtaatggagaaaaagttaatcaagaataaagattcaggcccaggtagtgtgcatctatagttgcagctactcaggaggctgaggcaagagaatctcttgagcccaggagttcagggccagcctgggcaacataatgagacccctacctctta

SEQ ID NO: 106937 - DNA, 359 bp, Homo sapiens
gacctgactctgaatttaattttttaagaatgtaatcataagtgaagcaactttaaatatagcattatagggcacagtattgataaatgagaggaaaactttttcttaaagagtgtaccactcacttaccatgccctgaaattaactgagaactcatttgtcaagagagcacctaccctatagagaattcttccaattaacatcaaaagcgatcattcttaacctctcatgcattaagaaaatcttgtctgcacccaatgttctgttcataatcaatgaagccccttatgtatgttattgcaaatttatcaccttgtatattactaaaatggatgaattaataaatgaatctgctgtag

SEQ ID NO: 106938 - DNA, 366 bp, Homo sapiens
tgaagagtgaggtgcataactgggactagaaacacaatggaaaaattctatttcctggtttgtcctggaatctattctgataacagtctatggcctctgcacagatgttttcatatggattagccaccaagcagtttaatgcattaagcctactataacagcaacaaattataatttgtttgtattgatgcacatgttagatagatagatgatagatatgtgagtatagatagatagagcgatagatgatagataggtagataggtagatcgatagagagacagatgtttccacttaaatgccctcatttacataagtttaaatagacatatgaattacagctcaggctgatttgacttcatttat

SEQ ID NO: 106939 - DNA, 322 bp, Homo sapiens
gatttgtaaaaacacaggctaagatccaagatggaaataaccagagctatgccttagggcctcctctgtgccaaggcttagagccttgtaaagctgctttatctgcattagttcccatccttataacatctctgtaatgtaagtttataatccccatattactgatgagaaagagaccacaagattaagaaacctgccaaaagttacacagccaagggattgagtggagcctaatattaaagactgtctgactcttcagcccacattattggtgtactagagagacaagaatggatgtcagaaaacaggttcggggggcagt

SEQ ID NO: 106940 - DNA, 675 bp, Homo sapiens
cagaccccactcatggactggaggcttccttaggcatgacatgctaagataatggggccttggtcctggcttgcgaggtggtggttccatggcaagagaggcaagccgagaggaccccagctgctctgcactgacagaggctctctccttacccaaactttagtcaggcttagaaactttttttttttttttttttgagacagagtctcactctgtcgcccaggctggagtacagtggcgtgatctcggctcaccgccacctccatctcccaggttcaccccattctcctgcctcagctacttgggaaagtagctgggactacaggcgcctgccaccacacctggctaatttttgtatttttagtagagacagggtttcaccgtgttagccaggatggtctcgatttcctgaccttgtgatccacccgcctcggcctcccgaagtgctgggattacaggtgtgagccactgcacctggccaggcttagaaacttttttagactaggcctcattcttggaccttgtcctcaagagcccagttttagcaagaatcctggcagtttaaaaagaatccccttgaccctttatatctgatcaacctgacctgacttaagcaagaatcctgtttggtaaatgtagcaagaatttcccttacccttcatttctgtctcctct

SEQ ID NO: 106941 - DNA, 592 bp, Homo sapiens
tggatttggaagaagttaagatagtatctgttcagcctcttgaatatcccttttggccctcctccttgcttaccagcatatgtaactccgaaaggataggagcagtgaaaacaaagcattattaaaagggaagatttttaattaggtggaagttgtttaagccctcccttcaacttacgtgttttagggaatgtggaacctgggaaattcgttactgaaattccttttgtttactttccttgtcttggggaggtagcaggtgacactgaaagaggcaacctgtaggcaataatatttgctcattctgtaaccctttgaaacctttgaaatgaagacttgccctcccctttgtttttgccatagttgccaagtatcttggttaacatggctgcaagtattaagtgtatttcttttaccatttttttttatgtcctgtaataacatagcctttggatgtggagcacccatttttcactctagttcagatcaacagagcgtaatttggttaaaataataaataaccttccttgaaatcttcgcatgagggaaggggggcaaaaaaaaaaaaaaagccctagaaagtagataataa

SEQ ID NO: 106942 - DNA, 350 bp, Homo sapiens
tagaattacacagcagcctgaaaagtcttacaaatagtgttgatgaaagaacacataaagtataattcaaaaagaggcaaaccaaaatatattattcaaggatgtacctgggtggtaaaactgtaaggaacgtatacaattactgttaagtcgagatagtggttactcctaagggattagggtgtgatcaagaagggtcacatgagaaaaagtcttcccgggtgcaagcagtgttttatttcttgatttgggtggtggttctacagatgtacactttataatcatttcttgttcgctacatttatgtttcatgtactttactatgtactatttcatttttttaaagttta

SEQ ID NO: 106943 - DNA, 3867 bp, Homo sapiens
cgcaggctccctgcgggtgcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggttggaaaccaaattgcacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatataacacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttccatggccctttagatctctttcaagcacattccattttcttctgatcatacttcctcagaaaacctttttttggctgggtgtggtggctcatgcctgtaatcccagcactgtgggaggctgaggtggttgtattgcttgaggccaggtgtttgaggccagccagggcaacacagcaagaccccatctctacaaaatattaaaacattagctaggcatggtggtgcacacctgtggtcctagcttcttgggaggctgaggtaggattgcttgagcccaggagtttgagccttcagtgagctatgatcgcgccactgtactccatcctgggtgatggagcgaagaacctgtctcttaaaaaaaaaaatttttttttaattaaaaaaacccaccctttttcatttcccaacattttttggctattatgatcgctatgtgttacttcaaataatttccagtgaatccacacttgatgttgcaaagcctaagtttgctgcagaaatacaatttcctacacttcatacctaaaggagattcagagctatcgctcaaaaccaaaagtcttggtttttaaatgtgcttagacaaaaaaaatcaggaaaggtaccctaatcgttcaacagcaatcatctttggggaatgggcattttggtaggtaaagtgtggtggacgtccttattattatttttgagacagtgtcttgctctgtctcccaggctggaggtcagtggcacaaatctcagctcactctaacctgcacctcccgggttcaagtgattctcatctcagcctcccaagtagtgtgaactaaaggcatgtgccaccacgcctggctaatttttgtatttttagtagagacagggtttcaccatgttggccaggctggtctcgaactcctggcctcaagtgatccacccacctcagccgcccaaagtgttgggattgcaggcatgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaaaat

SEQ ID NO: 106944 - DNA, 3824 bp, Homo sapiens
cgcaggctccctgcgggtgcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagttacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggttggaaaccaaattgcacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatataacacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttccatggccctttagatctctttcaagcacattccattttcttctgatcatacttcctcagaaaacctttttttggctgggtgtggtggctcatgcctgtaatcccagcactgtgggaggctgaggtggttgtattgcttgaggccaggtgtttgaggccagccagggcaacacagcaagaccccatctctacaaaatattaaaacattagctaggcatggtggtgcacacctgtggtcctagcttcttgggaggctgaggtaggattgcttgagcccaggagtttgagccttcagtgagctatgatcgcgccactgtactccatcctgggtgatggagcgaagaacctgtctcttaaaaaaaaaaatttttttttaattaaaaaaacccaccctttttcatttcccaacattttttggctattatgatcgctatgtgttacttcaaataatttccagtgaatccacacttgatgttgcaaagcctaagtttgctgcagaaatacaatttcctacacttcatacctaaaggagattcagagctatcgctcaaaaccaaaagtcttggtttttaaatgtgcttagacaaaaaaaatcaggaaaggtaccctaatcgttcaacagcaatcatctttggggaatgggcattttggtaggtaaagtgtggtggacgtccttattattatttttgagacagtgtcttgctctgtctcccaggctggaggtcagtggcacaaatctcagctcactctaacctgcacctcccgggttcaagtgattctcatctcagcctcccaagtagtgtgaactaaaggcatgtgccaccacgcctggctaatttttgtatttttagtagagacagggtttcaccatgttggccaggctggtctcgaactcctggcctcaagtgatccacccacctcagccgcccaaagtgttgggattgcaggcatgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaaaat

SEQ ID NO: 106945 - DNA, 2919 bp, Homo sapiens
cgcaggctccctgcgggtgcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggttggaaaccaaattgcacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatataacacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttcctgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaaaat

SEQ ID NO: 106946 - DNA, 3129 bp, Homo sapiens
cgcaggctccctgcgggtgcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggttggaaaccaaattgcacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatataacacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttccatggccctttagatctctttcaagcacattccattttcttctgatcatacttcctcagaaaacctttttttggctgggtgtggtggctcatgcctgtaatcccagcactgtgggaggctgaggtggttgtattgcttgaggctggtctcgaactcctggcctcaagtgatccacccacctcagccgcccaaagtgttgggattgcaggcatgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaaaat

SEQ ID NO: 106947 - DNA, 1382 bp, Homo sapiens
cgcaggctccctgcgggtgcaggctgggctcagctccgctggacccgcgctggggaactctggcctcgctgcactcatggcttctcctagcaaggcagtgattgttcccgggaacggaggcggggatgtgaccacccacggctggtggttgtattgcttgaggccaggtgtttgaggccagccagggcaacacagcaagaccccatctctacaaaatattaaaacattagtgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaaaat

SEQ ID NO: 106948 - DNA, 1370 bp, Homo sapiens
cgcaggctccctgcgggtgcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaatgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaaaat

SEQ ID NO: 106949 - DNA, 909 bp, Homo sapiens
ctgcgggtgcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaaggtaagcgcccaacgccgctgctccgtgaagtcagcctggagggagggacggcgggagaggactgagggctgaagtttgaataggcgtctaatcccctctagcaaagccctgtgtgttttcctgcctctcccccgctgccttctcttaaagtctgagctagtggtcgaattttgactggtaaaactgcctggaagacttctctgagggctcagcctttagagttaaaggaacccctttgaactaccgaggctgagcccctgagccccgccccccgtatctgctgctggttcagatttgggacttcccagataattttacatgttcactgcttcccgcttcagcttttaaaaaattaaatatgctatacttaatatatacaaaggatatacgtaacatgcgtctacattatgaggcataatgtaatgaattaccaaactaaaacctgggacattgcctatacatcatcttccaaacgacccttatgtctacccatctcagtcccgtgccatcctgaattttttcatctgcttctctttttaaaattgaagtacttttcaacctatgaatataccttttaaacaacagactgttctatttggcttcttggtgagctttataaaagtggcatcttactgtaggctgacctgtgccgtttgatttttattttttaaccctcttctgtaaccaggcggtaagtcggctccctgggttgctgtcctctagagcgggtctccagaatagatt

SEQ ID NO: 106950 - DNA, 290 bp, Homo sapiens
tgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcgacagtgagtaacttccagaagccaaaagagtttggcttcatgaggcaaggtgattgactcaatggcttgttgaatctcagcagttccgccatcttgaag

SEQ ID NO: 106951 - DNA, 1008 bp, Homo sapiens
cctggacaacagagtgagactctgtctccaaaaataaataaataagaaaaaaaaaaaaaagtgcagatggggcggggccagagctgggatggagctgactgttagcatccgttcagggcgtcggcaccatgggggcactatccagcgcagatctgcaagcccagcattcagcactccctcccccagccccagctgttgccagctgcatggggccagctgtgttgggtggggactgtgtagggtccagctatgagttggtggagtctgcgtggggactgtgtagggtccagctatgagttggtgaggcttaacaagcagtgcaggtgattccaatgcacactcatctgtggttttggaccacagatgtagatgttccagggaccacatggacaggggccattgcagacaggcctgaggacctcctgggcctgattgacttgaaggctagtttggggtctgggagctacagagatttggtggcagctctttcccatagggctaagacagatggggccaggaatacacctttcctccagcataggagccggaacaggtacctcaggaccctcttcaccccacagctggtgtctctcacccacatgggagcaagacccagcgccaggcagagaattcaggtttcaagactccaaatcagggctggttgcagtggctcatgcctttaatcccagtgctctgggagactgacatgggagaactgcttgaggccgagggttcgagagcagccctggcaacgtagtgagaccccccccccgccccggccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcggg

SEQ ID NO: 106952 - DNA, 384 bp, Homo sapiens
ttgaggccgagggttcgagagcagccctggcaacgtagtgagacccctcatgcctttaatcccagtgctctgggagactgacatgggagaactgcttgaggccgagggttcgagagcagccctggcaacgtagtgagaccccccccccgccccggccaccatctctacaaaaaaaaaaaaaagactccaaatcagaccggccagactagatgcctagagagatgtgtgggcacacccagagccatgtcctccgccagggaagccagcaactgtgatgctgggggtatggtagtgacaggcggtcgactcggggtaatattcttggaggagccgggcatggtggctcacacctataatcccggcactttgggaagccgaggcggg

SEQ ID NO: 106953 - DNA, 254 bp, Homo sapiens
aggcagatctgaagaaaatgtctaaccacacatttgtgcctgtaactttgcaggcaccatttggcagctgcagtgcgctaaggtcatctgtggcttggtctctgacatcctaggctcgaattttagcatggccatttactatctttggctctggcaaaatcatttaacttttccaagctcccatttccccttttataacatgggaccaaaaagctgggttggggtgacaaataaatggcaaaacacactgagta

SEQ ID NO: 106954 - DNA, 455 bp, Homo sapiens
tttttgagatggagtctcgctctgtcgcccaggctggagtacagtggcgcgatctcggctcactgcaagctccgcttcccaggttcacgccattcccctgcctcagcttcctgagtagctgggactacaggcgccagccaccacgcctgtctaattttttgtatttttagtagaaacggggtttcaccgtgttagccaggatggtctcaatctcctgacctcgtgatccgcccgtctcggcctcccaaagtgctgggattacaggcgtgagccaccgcgcctggcctccaactgagatcttaaccctactaggatgttaaaacatttacttttgtgcttttttccttaaagaaattaagagttcctaaaaggaagtgtcttagtcagtttgggctgctataacaaattaccacagactgggtgttttatgaacaacagaaatgtatttctcacac

SEQ ID NO: 106955 - DNA, 341 bp, Homo sapiens
aggcaggagtcagtttgggttgcaggccagagacagcagggcggggcggtgcagggactaaggccgggcaggtaagcagccaggtagcagcgggcatgtgcccatggtcccacggcagagctggctgctgaagggctacaggcagaagcatgaagggatcaagcgcacattctagaaagctctctctggctgcattctggaaggtggatcggaaggaagcaggagtaggggcaggcagagccagctcctgtgacagtcccagaagaacggggtggcacggggccagaagagggctcaggaacatggggtgcaaccgccaggcctgacgaccaagactcggg

SEQ ID NO: 106956 - DNA, 444 bp, Homo sapiens
actgattgaataaagaagatacaagttacagaaaagggtttttccctccctatgcgtgtgccctttattcttaaactctttgctttattattttgactgagactttctcagataaattctaattcagtttactccatgattttactgagattttctcttataaatcctgttgtatttatggtatgagcgcttaacactgtattgggtactataccagactttgggtagagcagtgcctaaaaagacaggctccttgtccaaaagttgtgaggaagagagaggctaaacaaaattgtaatgtcacttactgtttcaatctctaagtcaagtcttctttagtcacattttgtatgtttatttggtcccttctttacattctacctttggattaaaataagcacgttttcctctttgcattgtttttactaaagcactaatctgtgt

SEQ ID NO: 106957 - DNA, 319 bp, Homo sapiens
tctggtacccatttgtataagtctgagtaatgtcaagtctctttattgattatcaactacctgttgtgggaagtcagggatcctgaatggaaggaccagctgaagccatggcagaggaacataaattgtgaagatttcattttaatatggacatttatcaattcccaaataacacttttacaatttcttatgcctttcttactttaatctcttaatcctgttatcttagtaagctgaggatgtacatcacctcaggaccactgtgataattgtgttaactgtacaaattgattgtaaaacgtgtttgaacagtatgaaa

SEQ ID NO: 106958 - DNA, 658 bp, Homo sapiens
catgattagttggcttgcgcactgctcaccaatcaaaagagtcgcccggcggcgttagcgtccttttctgaagaaatccaagtactgggaatgcatgaggtcaattattgtcactcgtgaatcaaccaggtagctcctatgcgcaagcgttcgatatctatattctacgtctccctgccctgcaaataaaatgaaaactttgtaatttaatgtgtttcctttttgtcttcattgccagaaaactcagagctgaatatcttatccaggtgttataatcttttttttcctctttcacttttgatacctcagaataactttatctgtttccttcaggtgggttgtaatctatcttactctaaaatgtcttcacttgtactcggattaagacctcttaggtgtaaataaaatataaacctaaataattagatattgaaaagaggtaaaaggaaaagataaactgataggaactcacttttagataacagtagcaggacttcaaataaaacattcattttgaaaagatttgagtataagaaatgtgatttcaggcccgatgcagtggttcacacttgtaatcccagcactcaaaaaggccaaggtgggaggaacgcttgaggctaggtgttcagcaccagcctggacaacctaggaagacctc

SEQ ID NO: 106959 - DNA, 170 bp, Homo sapiens
ctgtagcccctggatgagctcatctactccatggcttacactctagtctctggatgagctcatctactccacagcttccactgtagtccctggatgagctcatctaccccatgacttcctctgtagcccctgggtgagcttgtctactccatggcttgcgttacctttac

SEQ ID NO: 106960 - DNA, 515 bp, Homo sapiens
  misc_feature (511)..(511): n is a, c, g, or t
gtgcagaattctgctttctctcttgagggcttctcccaagaacactaagaggttacagagtccagccaggccagtcctgcttccaaatatcttgccaagggagcctgggaaagctgactagttcactggtagatttcgcattttctgaggctgtggcttttgtgcatgggcccaggtttccactctgtttggccacagttcccaaaagcacatcttccttgtcagagtaagccatgcactctgctggaaccagctctcaataatctagaccttgatattgagcttaggagtctaggccagttcacccttttcttcttggccagattctccttgcagaccatctcagtcccatatacagaatctgaaccccaaaagggtaggaattataaatctctacgttttccccaaagcttctagttccccatgcaaatttggccacattctccccaaaacataccactcctgcataccatggagtattgatggagcatactttgataggccaaaaaanaaaa

SEQ ID NO: 106961 - DNA, 485 bp, Homo sapiens
cgaggtactctagaggatgttccgggagccttaaccctaggcgctgctatcatgcctggctgattttgtatttttagtagagacagggtttctccatgttggtcaggctgatcttgaactcccgacctcaggtgatccacccacctcggcctccccaagtgctgggattacaggcgtgcaccaccgcgcccggccagaaattataatcttatgggaccactgtcatgtgtatggtcctttgttcattgaaaatccttatgtgctgcatgactatatctgatatttacatgtgtgagcttcgtgctcagtgaggactccctgtatattaggaataatatcacaggaccagcaaggaagactagcctggaaccagaggtgagagttgtacaagatggcttagagatgacattgagagctagattatttagggccttgtgggctattcagaagcctttggattttattctaagacggagagccattgg

SEQ ID NO: 106962 - DNA, 117 bp, Homo sapiens
acgatcatatcccagcctgctctcgggtcaaaattcacaagcgtgactgccttttagtggaggcccagagaggttaagaaacttgcccaaggtcacacagcttgtcatgggcagata

SEQ ID NO: 106963 - DNA, 264 bp, Homo sapiens
attaatacctgaggatgaaattctaaaagtagaattttaacatcaaagggtttgcactttaaggcattttcagcctccatttctggctgttgctgttgtggacagtcttgggcagattttgaactctttgccttactgtggggtggtggaaaggaggctttaggagcagccagagcagggttcaaactccagccctgccagggacaactggccaaaaggtcgtgaactaatgactcagtgagttttctcatttataaaatagga

SEQ ID NO: 106964 - DNA, 350 bp, Homo sapiens
gttaatacttggaagatttttaaaatctttttgttttggtctgtttttgtttataacagctgtaatgagatataattcacataccataaaatttatccttaaaagtatacaactcagtggtttttagtatagtcagagttttgcaactattactagtatctatttttatattgattgattgattgattgattttttgagacagagtctcactcttgtttcccaggctggagtgcatggtgcaatctcggctcaccgcaacctccgcctcccaggttcaagtgattctcctgcctcaccctcccgagtagctgggattacaggcatgtgccaccatgcctggctaattttg

SEQ ID NO: 106965 - DNA, 455 bp, Homo sapiens
tctagagtaatgactcgtggttaacgaataccaacccccttttaaaacatgggcaaaagatttgaatcaacatttcagcgtacagacaataaacaaatggacttaagcacaagagatgctcaacatcagtcattattagggaaatgccaatcaaaactacaacgagataccctatatccactagtatggctatcataacaaagagtaacaaacgttgaggaggatatggagaaactcgagccctggtcaggtgtggtggatcacacctgtaattccaacaccctgggaagctgaggcaggcagaccacttcactgaacccaggagtttgagagccacctgggcaacaagccaaaaccccatttttacagaaaatacaaaaattagccaatcatggtggcatccacctgtagtcccagctactggggagtttgaggtgggaggattacttgagcct

SEQ ID NO: 106966 - DNA, 443 bp, Homo sapiens
acatagaagatgcacattaaatgcttagtaaatgtatggaaacatttcacatatgagtagaaagaaataatgcagaggaaattagatgtaagtacatatgtataattgtaattttacttatgattttgaacaatctatcttcttatagcagcttcctgctagttttacctaactcagagctaactttgtcttaccttctccaggaggtaagatttagaaacctactaaagtgctctcagacatcagttattttgtaagtcagagttgttatctatgatacattaacatgtttgatgatgtgaatgctcaaattttacaagatcttttgttcctcttctgcataattcagttcttttaagaacaacttatgtgttgtagttccatgtgtgtatttcagactagtcaacacaactaaaatctgatcatgattactagcttttcaa

SEQ ID NO: 106967 - DNA, 439 bp, Homo sapiens
acaacgtctgcctccacgtgaaccacaattacagaccccaaacaaaacgtgtgtgtgtgtgtactgggtgtgccagcctccttatacagagattgtttagtagcccatcatcaagttactaaggttatttgctcagtagttctactggatatggattgagacatcacacctagacttgcctagctcctcttgtaaccagagtatcttttatgcttcttggaaagtaagagtgtagtcttgcccctgaagtagagttaaaaggtttgcacgataatctaacccttaaccttatcctaatctggactgtggtctcacagactgaactaattggcgcagtattcaagtattctaatacttggtgattagcaaaaacactacaacccagtgaaataggttgggcatgtattcacatgcctatttaacatatgagaaaacagat

SEQ ID NO: 106968 - DNA, 269 bp, Homo sapiens
gacttgtgtttaaagataaaaacaagactattttatatttcccaaagattgtttttgaccctttaagtaggaaatgattttctaagcctaagtaaaataaatcaaagaagtactctgttatgcaagttttttaacttcagagttatgacttctaaactgccatgcccaccaagggcagcttccagggaattaaaataaggataggcttgtggcatggcaaatatttgacaaggatgtcttcccatgcctagtcaactctatgaaatact

SEQ ID NO: 106969 - DNA, 422 bp, Homo sapiens
ttcttgaagtgggtagctgccattctgggagctggggctgaaacgggtattcattgccattcagaaccaggcctttgacagctctgctgtctcacatctgctgagggcatcaagcaccggttcagtagggaaagaaggatggggaaaggctgtggggagagaggttgggtaacattagggagatgccaagaatctggctattcaagacagtgttcacagcaccaacaattgcagaaaacattcattgagtggttgtaaattagcacttgaatcccactatcctctttttcaactgccaaatttgtttgtttttcaccagaagagacttagtgattggaattttgtaattgtgatattagctattggtcctgcattcatcacagaactaattaatgcacccatagaagagaaaataaattccc

SEQ ID NO: 106970 - DNA, 420 bp, Homo sapiens
ggcggagacagcaggaagcccaaaacccgagctgggtttcctgcttggagtcgcagggtgtggcaatgttgaagttcgccgtgcccctgctccctatgggaattagaatccggtccaggacaagcatcgggaaagggggacagtttgtgaccgaggaaactaggactgatccagaacagcgcaggcagagacgcgctgggctcatgaagcgcgacaaaggccccgacccctcttccgcttggctcgttggtctaggggtgtggttctcgcttagggaccacagggacaagcccgggagacccaagaggtcccgggttcaaatcccggacgagcccacactttaagaacccagcaggggctgggcgcggtcgctcacgcctgtaatcccagcactttgggaggccgaagcagtggatcact

SEQ ID NO: 106971 - DNA, 409 bp, Homo sapiens
agacggcatggggtctgtaagtagaatctgagcctggaacgaaggataatcatgcatccctctgcatagatgaggatcgcactctccttgctgcccagcagtgagtgacttcagctgctctcctcaaggctatttttggaatcccttttcaaatttcttccagagttattggtctgttcaggtattgaactttatgtgtcaactttgcaaatttaggttttctgacaatatcattcactttaatcaagattttaaagttaattagcaagaatcagaaattcctatataatttttacaattacttctgtaattttagcccttcttttaacgtaacttgttttcttttaaaatacaggtccatatgtatattaagtatttttttttcttttttctttttcttttttttttt

SEQ ID NO: 106972 - DNA, 382 bp, Homo sapiens
tgcccttataaaaatctttaatccttccactcttttgggtattgactgggcgccaagtggatttgcatattattacaaagcgaaatgtgtgaatacagccagccagccatcctgttaaaaatctgggttgaaaaccacatggatttgctgaacaacaaattcacattggagaggtatcaccaactgctgcctaaaaacatccccaggatgccggggcgtggaaatgtagccgagcccagcttctgaaacacaatgattccactgaaatctgcatctctttcagtgggacttggttaaatttagaagagtccctcagtgaaggggtcaccgggcaaatgaccagagctcacagaccagcagacagcccaggtcccgcactgtc

SEQ ID NO: 106973 - DNA, 598 bp, Homo sapiens
cggacggtatatggcatagctgttccttgtgtaaactctgcgatgcagaatcctcgatacagtgtactataggtgtcatgcctttaacccttgtatagcgtcttgcttttatactcatgtcatatttgacctcaccaagacacgactgtgtggactgctctaggctggcacaggcccctctggagagctgttgcatgaggtgagtgggctgatgaacagatgtttttagcattagggcgctcttaaactgtctcacctagtataaaagttcaaggttctcattcactgcaaaaagacctgcaactacaagaaagagaatcccaaggtgggctttgcatggatatagaagtcttggtattaaacctaacttttctaaggaataagacattttggggtaggattatctattggtgtataatattttggaatgttccttattactgccttacctttctccttgactgaaacatttggtctctttctaacaatagtgaggtggaatagaaatacactccatacaaaagcaggttccaggggaattgaaagtaagccacagatgagctagagaaggctgctgataagaatatgttgcacaaat

SEQ ID NO: 106974 - DNA, 380 bp, Homo sapiens
gtagtaaaacacacgaaaccagtataaaattttcacctatctcttttattaacagatttacattcccatcacaaaactacttagtttactgggtaatcaaatcctattgtttttcccttacacattttgtaaaaagaaaaaaaccttttaccttctaaaacacgtaataagaaaattacatagataaaagacattactgggccaggcatggtggttcatacctgtaatcccagggctttgagaagccaatgcaggaggattgcttgagcctgggattttgagaccagcctgggcaacacagtgagatcgtgtctctacaaaaaataaaaatattggcccagggagtggtggctcatgcctgtaatcccagcactttggga

SEQ ID NO: 106975 - DNA, 353 bp, Homo sapiens
ctgagcatggcaaaagtagcctcaaagtccagttttacaatctatgctatctcagcacacgctgagcactcaccatgtgataggtgtgttcaaaacatcacctgtgtatggttttatttaatcctccaagcacatctgtgtgctattattcccatttcagaggctgagatgaaactgaggcccagagacgtgcattctcgccccaggtcacacagcaagggctttgcatggctggaatcccctccagagctgcctctcctcgccccctgtcaccacctgcaggctttcctgggtgaagtgattcttgcggagggattctagtcctctgtgcagacaggaattgtggtggaggc

SEQ ID NO: 106976 - DNA, 699 bp, Homo sapiens
gcttggtacctgggtagaattcacttctccaaagatgtcattttatttattttttattgttttttgagacgtggtctcactctgtcacccaggctagagtgctgcagcacaatcgtggctcaatgcagcctcgacctcctgggctcaagcaatccttccacctcagctcccaagcagctgggaccacaggggtacaccataacacctaggttttgttttgttttttaattttttggcagagagagggtttccctatgttgcccaggttggtctccaattcctgggctcaagcaatcctccagcctcagcctccagaagtgctgggattaccaccacacctggccaaaagatgccattttaaagaaagccttaaaagtcaggcacagtggttcatgcctgcagtcccagcactctggtagcccaaggcaggtagatcgcttgaggccaagagtttgaaaccccatctctactaaaaatacaaaaattagccaggcgtggtggtgcacgcctgtaatcccagctacttgggtggctgaggcccaagaatcacttgaacccacaaggcagacgttgcaacaagtcaagatcacaccactgcactccagcctgggagacacagagcaagattctgtctcaaaaaacaataataaaattaaattaaattttaaaataaagtctttcagctgaaatgagtactgt

SEQ ID NO: 106977 - DNA, 176 bp, Homo sapiens
atgggatgtctgaggtgaataagggtgcttaccttcatggcccctagtgaaggggccaggtgggccaggggtcttctctgaaaggtatctgagtcccctcatttctttttttttttttttttttttttttttttttttttgggcccccccccaaaaattccccggcgggtgcccgg

SEQ ID NO: 106978 - DNA, 669 bp, Homo sapiens
gatgttgatttttgccatagaaactgtaaattagatcatccctagatacagaaaattgccaacaaaaggggagaataaaatgtaggtatgttacacaaccaaatgtttcctgtttgttgcgtgaaaataagtataattaccaaataaaacgttttatatctggttttatggaaggacaaaagacagtaaccacaatgaacacccactgtgtgcattgataatgtatgaacttttaaatgcttcaattttttgccatggtcacacttcggattctgttctagtctctctggtaatagtatgctgtaatcccagaagtttctatattttgaaatattacagagggactatactttagcctagatctataatttgacttcaggatatgctttaaatgccctttaagtgtatttttgttgtttacttttctgtttatagttgtttagaattgttctcattgaggcattgtgacattgcatactttagagcacttaatactactttttttttttttctttaaatgataggagacttgaatcttgcccacattccttcaggtatgctactgaaggttttgtggcaaagtgctattagcagaacaaaaaggttttaacaccgtcttgaaatttttatttattatctggtcccaggtgtgtaggctgtgagtatttc

SEQ ID NO: 106979 - DNA, 599 bp, Homo sapiens
ttcctcgcttctcctgaccgctggaggtctgtgctcttagaagctcctgctctggcctctggcaggatgagagcagagcagttgggagcttccgtggagggcagcctgacctggcagatcactgaaggtgataattagaggctcaggctcacagctgcattagaaaagctaggaagcacaaagggcctcggcagggaaggccattagtcaccggcctaactgccctggccgggtctggttgacctgggcgaggacctggctatgcccatgtggctccaacttgtggatgctgcctctgtgggtgggcggcgggacaggctcaccccactggtgctggggcagtggggccagccaggcctcaccagcacatggacacctccctcctccctactgaagagctcgtggggtggagggcggcatcccgctctcccccttccttgtggagggacgtgaagggaggctgtgttggccacaggtcctccctgtggcccactcctggcccctccactggccaggctcctcttgttcccaggctggaactcctggcccgtgtggtcttgctgttccaggatggaatcgtcccatttctaaggggtacc

SEQ ID NO: 106980 - DNA, 267 bp, Homo sapiens
tgtaaaagttatcagtaatcctaattcttttcctgggttttccttttgtcacttattaatcagtttttgaaaggacgaatgaatttagagatgtactctggagcagtatcatgttaaaccaggggtatattagaaaaatcatcctcataatcattctgggaagtttttcctccccaaaaaaagccatcctgatgggttttcaaaaccagaaaaaagctcttaatgaggaacagaccactggagtacccatgagcatctcaggaaaac

SEQ ID NO: 106981 - DNA, 500 bp, Homo sapiens
tgcaagaaaactaagaaactcaagtaggcagggcttcaagggttcccaggggtttggctggcagcatctgaatcacctaggtcaccaggttcaaaaagcaacttcctggtttggtcctactcccagagactctgcttcctgaggtctggggctcacacctgcattttagcaaatgctccaggagatgctattatagtgatgatgacaccacagctgctatgtaataactacttgttgcagcctgtattaaggtgacctagctggtcactggctcccccaggattcacacccaagcaatttggcatgtctgtgctgagactcctggtaaagctgggtttggagaaaaggacggttatactaagaccctgttcatgaacatctactgtgcaggcactgagcttagccttcccaggaagtcagcccactgccacatcccatgatggttatccttttgcagaggaggaagaccaatgcttcacaaggagagggaaaatagccca

SEQ ID NO: 106982 - DNA, 499 bp, Homo sapiens
ggcaccaaacccagacaggaaatatttattttgggtctcaggaaaaggttccattttcctcccttgagttttcttccattcctggacttgctagggtgttcttggattattggaatgaatcgtctatttgaaaagagaaaaccttgcttttattctaaactccgtggtgatgggtgtgtgtgttttcaaaattggttttttcgttgctatttagtgcaaggcccaaggacaggtctggcttaagccaggtgtctgccaaacatatacccaaggtgggagttggggtgagaattgtctttaagaccctgggagagaaggattctaaagtgactgagagtggtgtcctggcttgggtcccacagatgtgttgggttttgattggtgatgacctgtgggtcccctgaatgtgtgtgtggattgacatgtgggtgttagccttcgagaaggtggagcagtggcttatagaaggcttttgtggttttatgttgttggtattgct

SEQ ID NO: 106983 - DNA, 384 bp, Homo sapiens
ccctcgcgaacgtgtatcccatttgggcatcaagaactactcctgtagactcttcctttgtaagttatcttacagctggccattgttttttattttcactgctagcacctcagtccaactctttaggcagtaaataacagaacatctgggttaggacaccaatggatctctcttccatgaatctcttttccctctgaagtttacaggactgctatatcagcagcaccattttcttgtaactagcctatccaaaatcctttactgtttcccagaccttttagcttcacattcaagggcaattggctatcggaaaacaaacacaagatggatgagtcaccttaaatcccttttttagcaagctggtggataactaaacaaagagag

SEQ ID NO: 106984 - DNA, 612 bp, Homo sapiens
tctttcttgtgctgatcatttttattgtcgcacatttcaggcaaataagaaacagcagagaaccacctgtgttacacaccacccagtatgagaaacaaagttacaaatgctatgggaaatattttttgaaaactagcatggacctcaagaggggcttgcactggagggtgcacctgctttgccagaggtggaagccttttgcagcattgggcctccctcctaacactacacatcctgctggctggcctggcctcacctggtccccgagctccacactggaactggacaatgagactggccccaccgttaggtctaaatgaagaggcacctgctgtatagttgactgaatttgtcacctcctgctcggtgccatttctgcttgtctccgtgagcctggggcaaggctgtattccttagctctgagaaatctgtgcagtgccttcagagagacaattccagtgtcagatttctgaatctgtcacctaagccatgacaattcgttgtcttttttgtaagcctacttctgcagttactatatgaaaaatctcttgtaaagctcttagacaaatgggcatacttcacaacacattatgatgtgcatgtgtgtgttct

SEQ ID NO: 106985 - DNA, 270 bp, Homo sapiens
tggtggggggtgtttgtttttgttttgctttttagtttgcttagttgtctctgtaactaatctcaccagactcttaaccaggagtgtaaatcttcttctgaaatactcaagcatgaatttcagtctatcggtcctccttttaattggtgacatccctcctgaagatctctcgatttattttcacagcctgagttctttgctctctaagccgtcacacattctgggagttctcttctccctctttctggggatttcctttacctgtgctga

SEQ ID NO: 106986 - DNA, 452 bp, Homo sapiens
gagcaacattagaccagatactttttttcaccaagaaaaaaaaaatcagaatcttggctttcaacattagaaatttctcatcccagatacttaataagtgagaataatttgccttccaattttttgacacccaatagtttttccaagttaaattttaaaaaagcataagaaagtaagcagctctggcggagcgcggtggctcaggcctataatcccagcactttgggaggctgaggcgggcggatcacgaggtcaggagtttgagaccagtctgaccaacatggtgaaaccgtctctactaaaaatacaaaaattagccgggggtggtggtgtggaatgcctgtaatcccagctactcaggaggctgaggcaggagaatcacttgaaccctggaggtggaggttgtggtgagccgaaatcatgtcactgcactgcagcctggtgactgtctc

SEQ ID NO: 106987 - DNA, 810 bp, Homo sapiens
gatctacatattatgaagatgtaatgagataatgaatgtaattggacttaaaacagtacctggcacatagtgtattattactattgtatttgtcaccaggtgcttttacacatatatgcatataattagctatgcgatgctcagttattatgtccaactacttcagggatgatttcaaggggaactcaaaatgacaagcaagtggtatacatgtccacaccctagattaggaaaagatagccttagtcttttggtgtgggtacttagacctcttttgtccaggctctgttgtaggtgcttaagtgttaggacctttaggaatgattcttgcaaaagtgaatgttaaaggcttagagattactatggcacgcccacatggaagcatctgtttattctggtagtgcttgtgacaacacatagacttctcagaaccaagatgagaaaagacatcctcacaagatatcaaggtttttctgtgtgtctgaaacctcaagagataaaggagtaatctttgggcatgagaacccatgagagatatgaagggatttaattgaatgaaagaatgaataaaaagctacatacatttattaagtattttgtgtatgttaggccctatactggtgatagacagacatgtagtgaggctgaggtgggaggatgggttaaagcatcttcacagctcagtactgggaaggtgagtggacgatggttaagctgcgaagcggaggtggagtgagccaagatcatgccatgaactccagctgggtaacaggagtggagaaccacatcttaaaagaaatacaaaacgaa

SEQ ID NO: 106988 - DNA, 367 bp, Homo sapiens
ggtagtattacagctagaactaagacctaaagtcaagttttgtggtttatctttctctatacagcatggccacttttgtaaaaattagatgattagccaaaaatgaaataaagcaaaaacaaacccccaaacccacccatctgcaggaaggaaggcagaaactgctcaagggcagagaaaagcgcagcttggccttttcaaataaatcacaaaacacgtttgagtttaaaaatagtgttgataacataacctcacttaggctgggcgtggtggctcacacctgtaatctcagcactttgggaggccatggagggtggatggcttccactcataaattggagaccagcctcggcaacatggcaatacc

SEQ ID NO: 106989 - DNA, 487 bp, Homo sapiens
ttcacaaggacgtgaggcattcacaccctcctgtttcctactagggaaggcactgacgtcagttttcacacattggaagcctggggccaggcgtgcatttttattttggtgaagaattctttatgctccttgatgttcctataaaacacaagcagaacgctagaatttgctcgtggtgcgtccgaggtctgttgctctctgtgcggtatctgcaggagattcagagtaggatccttttgtgacattggcaaaaacaagcgcaactgtcggtgattgttagagtgtgtgtttagccccttagatttgagggaatttgtgtgtgtcttctctgtctgccctctcttaaattataaaatccccaaggggcaaggtgcagtggctcatacctataatcctagcacttttggaggccaaggcaggtggatcgcttgagtccaggaattcaagaccagactggtcaatgcagcaaaaccctgtctctactgaa

SEQ ID NO: 106990 - DNA, 323 bp, Homo sapiens
acagccatccgcagaggcagctttttgctagagcctcattttgcccctgaaatcttgggctgtgtgagttaaacaagccctctccactcagaccagctgggcaggagtgtttgaccctagagagatttatgaggtcggtggagcagtcctgcctctggccccagggaattcatgctcagcccgattttgatggtgaccagacgtgcctcctaaaacacaaggtggccctggaggcctggggaggagagtgcagtctacccacttggccccttcttcccggccctgagtcagtgaccttcacctaaatcctaaaaggactctgt

SEQ ID NO: 106991 - DNA, 232 bp, Homo sapiens
atccaagatatcagcatatttttaaagtcccaggtgatgtgatgtaatgtaatatgctaccaggttcaggatatagtggaccaagcccagggtgggctcagactccacagagccccttttctgtggtctgagtagatattcatggggtgaggagtaaagctctgtgttcatgaagaacggagtgggctagaagccaggacccctgggccggcctcgtgctgcagacacttct

SEQ ID NO: 106992 - DNA, 406 bp, Homo sapiens
ctcctgggttgtgtgtgtggcaggctgatctctagttctccaggtgacgtgtgcaggttctggtggtgggtaggcaggtgtttcctcaggcctctcagtagtaagtgtgagcgccagctctggaggcagtgtgagtcagtctccaggcccccagatggtacattcaggcaccagcatattcctatgcatttctagataatagtatttttcagaaaacctgagcatatgtcctattaatacaactttccctcatcagctctgcatgagaagaagggggatttccctcagtagaacagtcacaatggaatcatagacttgttttgagccactcactggtatgtgggggtaggctaaaatgataagctcagaatctaaaccttagactagggaatggctaactttttcc

SEQ ID NO: 106993 - DNA, 306 bp, Homo sapiens
ctcaactgtaaatcaaattatattcttcaggaccaaagcaggctgccttaacagttgtatgcatgtccctgcatacatctgtgagttgtgtgtgtatttaaaatgtgtctttaattaaccatcccattgtgttcaacgagttggtcttagccactgattgaaaggcactgagttgcttatcaaaaacaaattgttgccatctgtataataaatgacgaatggtattaacaccataatgaaattcagaaatcaagattgataaggagagggatatttttgatacccaaagtttgcttttttcccccc

SEQ ID NO: 106994 - DNA, 311 bp, Homo sapiens
tcttttgccttgacctcccaaagagctgggattacaggtctaagcctgaataggatttctgtaacatttaatagaaagagtcctggctaatagttccttggtaaagggcaaggtatacagatagcaacaatcaaaactaaagaacataaagcagggagaatttagagatttggttcctttcttgagcctgcacttgtgggtaagcttctcttccaaagatatctgcatttctaaaaaccttcctttggccactataacacttggtgtcttaaagcaacagaaatgtattctctcacagttctggatgccaa

SEQ ID NO: 106995 - DNA, 401 bp, Homo sapiens
tatcactgttttttagttttccttgtagaagtctttcgcatccttggttaagcgtattctgagggtttcttctgtgtgtgtgagtgtgtgtgtgtgtgtgtgtgtgtgtgtgtgtgtgtatgtggctaacataaatgggattactttcttgattgcttttttcagctagttcatatatacagtttttaatcttaaaaaagcatgatatttttccattttacaaaaggatagtaggcaaacattaaacgttaaggacttcctcatggatacaaatcccagtatatgtctaaataaattaggactcaaatttatatacatatagctactttccaagtccaatctttctcccctgtataagtcctccttcccctgaaaaataaatggtttggggctttattctg

SEQ ID NO: 106996 - DNA, 570 bp, Homo sapiens
ctagatattcgtatattgcaatattcgtttttttctcttctgcagcttttttttgtcttctgaggctagttcattcttttatccctttgaaaatattgatctgaaaaaggtctatatttatgtttataaatatatgtatatatacacacacacagccatcccttatcccaagaactctgaataaccattcctctaagccgtgagtcataagctttgcatgttgaaggtatagactcaaacctttgaaacccagatcaacagatttactttctagaagcatctgtaaattttccagatgaatcaatattgggtctagtaaccattcatctttgcataatttggtctgtatttcattctagatcttattgaatttcagtaaaggtcaaagatagtactagctttgatgcccagtactgttctgtggaagaatcagaactaagtcatttcttattctgaaagccagtagctgctgggagaaaagcagacagataatcctaaagcagaaaatttcaaaatatgtgtatatgtcataatatatgcattatctatgattggaataacagaagaatc

SEQ ID NO: 106997 - DNA, 429 bp, Homo sapiens
ttggcaagaaactgactacttaaggctttcagttaggtgtagctatgcttcccttgggcttctcagtgtgttcattgatggcttgtgattccagttgaaattcctggtctatacctcagcttcctccaacatgggggtagtggtggggcctatttttggggttttgtatgattcttatgtttctataagtctgtgttttgtttccttgaaggggtaattgctagttgtcttccatcatattttatctacaatatacctaaattttttttttcgggtttacatcctttcctaatttctagtgttagtgaagatttctctttttctcttatgtttgtcatgatctttagtcacttcagtacttgctggtagtgaggggagaatgctcaagttaagtctttctggtatcttcccttccctttttctcctctc

SEQ ID NO: 106998 - DNA, 667 bp, Homo sapiens
tgcctctgaatgcaaggcattgtgctgggtggtacccacagctagttaaatagagccttctgggtcaggagcttacactctaaaatggatagtttcaacagagcaggagaggagaagggcagagaacgtggagctaaaaccataatacagagtttgtggttaagagtttgtggcttctgagccagagtatgaatgagtaagtcactggataagggaggaagattgtgtccttcctctggcagaagagctatcagtggagaaggggcaagatcatgttcagagcagaataaacgaacttcatttatgtgacagaagtagggatctgtgggaagttggcaggggtagggtgaggtgagtttgtgtgtcaaggcttggtgctagatgtggcaaatagagtaaaaatatgacacagagtgggcaagagaccagagctgtatataccacagggcctgcagcggcctttgtatgactagcactggaaatgtagggcctacttagcagctaggtttattttcagaaatgtgcatggggaaatagttggattgaatatagaagtttgagtgttgactcttgtatttaaatatctgcttggctttgaataaatcatctaatccttgctgaactgtggtttcctcacctggaagatgggaagaataatcattcttcc

SEQ ID NO: 106999 - DNA, 272 bp, Homo sapiens
gttgtctgtaggctcctactgatagggcttcaaatgaggaatgaagccctatctgggcagctctggggaagggagtaaggaggaagggaatacagatgctttcattgtagtctcagttccggaacttgtgctcagcttttcacataaaatgtctcatcaggatgccttgaagctttttaaccccaagaggattcctggttctcacccctattcagtaagccatggacagctgcacaggaagtgtggttctgaagggacccagccccactgtg

SEQ ID NO: 107000 - DNA, 256 bp, Homo sapiens
cccccgcgcgcaggtatatagcaagcactatctaaggtagtctatgtgatacatgcatcacagagtacagatgactgtagctctgctgtcatttgagctgccaggcactgtgctgggtagtggggatatggagatgaattagacaccatccccgtcctcaaggagttctcagtctagtgagagagatcaacatctatgtacacatataattacaacaatatggtatgctctacaatggaggtatgtataagatact

SEQ ID NO: 107001 - DNA, 182 bp, Homo sapiens
cgagccgagctgggcggaagaaggcgaggcgggagccaggcccgtccctgaccgccgcggcgccgaccgtgacaaacactcatcgttgggtggggctctagtgcagtccgttggtgccaatattttataagcgacgttttcaaactatgtgaagatcctttcttttcttttctttctttctt

SEQ ID NO: 107002 - DNA, 353 bp, Homo sapiens
cggtctgttgaatgtctcctctgtaccaggcaggaaggggccgtgggagaagagtccactgataacacagtgttgtcggtgccctgatggggcatcagctactctgggagtcccgggagggacagaggggccagcccaaagctagagatggctgcgcagaggcagcaaagaccagagagtttgggctttatcagcaccaagactggggtgagaagtgcctcaagcagagacggctttctaggtgtgagccgcatgcaaagtggagctttagtcaacgaagcggaaacaaggactgcaagacttgagggtttccaaggctcctgtgagaggagctccctctcctgttgatttct

SEQ ID NO: 107003 - DNA, 415 bp, Homo sapiens
taccccagtggggactctgtgtgggggctccaaccccacattttcccaccacactgccctagtagaggttactgtgagggctctgcccctgaagcaggcttctgcctgggcacccaggttttctcatacatcctctgaaatctaggcaggggctgtcaagccttcactcttgcactctgtgtgcccacaggcttaacaccacgtgaaagccaccaaagcttacagcttgcgctctcccgagtagcagcccaagctgtatctggggccctttgaatcatgactgatgccatgactggagccacagcagctggaatgcagggagcactgtcctgaggctgtgcagggtagcgggggcactggctggcctgtgaaatcattcttttttcttaggcctctgggcctctcgtggcggggg

SEQ ID NO: 107004 - DNA, 649 bp, Homo sapiens
gccccagaaagcagatgaaatctttctgtgaagtgctgacttcacctccctgagagccataaaagaatgccccttaacacagtaagccaaagctctgcaggatgatgacttctggatggaaaatgcccctcaatacagtaagccaaagctctgcagggtgatgacttctggatggaaaatgcccctcaatacagtaagccaaagctctgcagggcgatgacttctggatggttgctccagttaacatggtgcaagaagctgtaactgtcagcccaaagaaaaaggcaatggccgagaataatcagagcccataatgaacacagttaatggcacccgcaacacgctttctaagtgatgttaacatcaaaatatggaaagcaacacctccagctatcctgctgccttcctcgaagtattctttctcaatccttatatatatgctccctccacttgctgcttttctttttttagagacagagtctcactttgtgcagtggtgcaatcacggctcattgcagcctctaattcctgggctcaactgatcccctcacctcagcctcctgagtagctaggactacaggcatgcaccaccaccatgcctggctaatttttaaattttttatacaaacagggtctcactatgttgccc

SEQ ID NO: 107005 - DNA, 199 bp, Homo sapiens
cacagagagcttcccttgtcctctccttgtagagtcatcaatgctttactctcctggcattcgtgtatgataatatacttgtaatatttttaatcagagaagctcacctgagtttttgatgtccagagtttttttttttttttttggtttggtttttttttttgttttgttttgttttttttgcagttcattatatttt

SEQ ID NO: 107006 - DNA, 220 bp, Homo sapiens
tttcagtctgtgttcacactgctttatgagtccagtttgcttagattttttgtgggggtacttagatgtagctgctttgggaagagggacacgtggaaaatatagagggagatggggaatatttagttcagcattttatatgctataaataattatagctgtatagccaaatgagcttttagagctctggattccattggaatttaaggatttttctctt

SEQ ID NO: 107007 - DNA, 262 bp, Homo sapiens
tagggttttgcaaaaagctgccttggccctgcccttcccagaagggccccatccagggactgactgtggaggaggtaaaaaggtcactggggcccaactccggacagccatgaagagcctttaaccccagagctgctgcgggtgcctgcctggcctcactgtgggatgatctctgtcttctcaatcccactgccttcccctcccttccaaaggcattggtcccaagggccctccttgatgaaacccatctgggaggaaccca

SEQ ID NO: 107008 - DNA, 461 bp, Homo sapiens
cttgctctgccccttgcaaagtccagtgagccgttcaaagataacccagatgtcccaagcctcccagccagagtgcctgtgctgcgcagctggcgtggttgccccagtctccttcgccccaaggccatgcttggccgaccccctgacccgctgaggttgcgcagagctttttgggccctgtagcagcactgcttgggcaccaagccttgcatggtctcatgggactcactgcctgcagccgctagtcccagctcccctccttaccagaacccacaccatgttgtccagctgatgggggatcacatatcatgctattccctccaggatcctgtcccctgtttttctccccctgccatgaggagtagcatcctcatttagcctttccctcagaaagtccccacgcttatcactacacatgaatagatcccaggaaggtcactttctcatggttctgcaaaaag

SEQ ID NO: 107009 - DNA, 420 bp, Homo sapiens
caataaaacaacccagggaaaatcattctaattttaggagaaaaattaacacctacctaccctacaacctcacaattaaaatctggtggaattctataaccttccacatggtttgcctcttgtgtggtgggaaagtgagagggagcttttattgacttctttgagagaatgaagaggaaagaagacaacactgttgaagaatcttctataatctagatgtcagaagaagccacccactctttgattctaagattgccttgctccatcccccattctatgttctgttctgttgttttttttttttccctgaacatttctacaaatactttcttctagtatttgtggaatacttcattctataactaatggctatttgtttatctccaatccagcattgacctaaagttcagacatgactct

SEQ ID NO: 107010 - DNA, 3329 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagttacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaa

SEQ ID NO: 107011 - DNA, 1219 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggcggtacatcgtgcgcttcgggagtcctctagagtca

SEQ ID NO: 107012 - DNA, 688 bp, Homo sapiens
tgcgtaaacaatgtttcaaaactgcaaaatggattctacgctaccactcctttcttctgctcaatccacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgaggtataatttttaattcttctaatttgtagttttctaagaagagaggggatagatttcattcttggtggcattcagtaagtatataaatgtactcacagcttttatttactgtgtgttacctttttctgtgaatcttcatttcgttgatgtcattattatgaagacaaaaaaatgtcttttgggatttttttgggaatctgtactttatctttgagtcttcatta

SEQ ID NO: 107013 - DNA, 819 bp, Homo sapiens
agctgctggacatggaactacagagaagtgtaaaaactaactctgggcccggcgtggtggcttatgcatgtaatcccagcactttgggaggccgaggccggcggatcacgaggtcaggagttcgagaccagcctggccaacacggtgaaaacctgtctctactaaaaatacaaaaattacccgggcgtggtggtgatgcctgtaatcccagctactcggaaggctgaggcaggagaatcgcttgagactgggaggtggaggttgtggagctgagattgcgccattgtgctacatcctgggcaacaagagcgaaactccgtctcaaaaaaaaaaaaatttcccagatgttaatgttttactgccatttgtatagcactgtttttcaaactgcaatatagggatcctttagtagattataagaaattaatttagtgggccatgactacttgtttttccttttctcccctcagttgttggcaatacttaaaaaaatttgtatctaaataaaaatggtaggccaggcacagtggctcgcacctggaatcccagcactttgggaggccaaggtgggaggattgcttgagtccaggaggtggaaaccagcctgggcaacagagcaagaccctgcctctactaaaaaaataaaaaattaaaaaattaaaaatcagctgtgcgcagtggcatgagcctatagttccaactacttgggaggctgaggcaggatgatcacttgagcccgggagactgaggctacaatgagctataatcatgccactgccactgcattccagcctgggtgacacagtgagatcctgtcac

SEQ ID NO: 107014 - DNA, 4084 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaa

SEQ ID NO: 107015 - DNA, 5957 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattagatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaatgaagatttttcgaaatgtgccttttaatccagttaatgaatgaagctatatgcagtgtttcaaatgaataagtcaaaacaccatatgttttcataataccacatgaaaaatcaagattttgcaatgtaggtacacaaaattctatatgttcttctccatttgtgattttgaaactgtttaaattggtagggggacaatcgtatagtcatcttcaatagccatttagaaatggttaatattcttgcccactggtatggtatccagagaagatatggtttccatctttgagaaaataattctctgatgagacaatttgccctctgtagatattcacatacagagaattgccaaacttcataaaagggtagtatgaagtagatgccctgatttttgtgagtataagaagtacagatgatggtttggaaactgtcacatctgtctgctgatacatgttagtagatgaaaaactgtttccttctgctcagaactggaattaagccccactcatgctaataaaaatgggtttttatagtagtattcacatacagtttattattcacacactgggggagggtgatgaataatgattatttaatgagccctcttcctagttttccctaagtctgcagaagacaaagatcctgtttccaggccatgaaaggactgaagtaaatattgtaaataagtacagctgacccttgaacaacatggaggttaggggttcagttgaaaatctgcatgtaagtggacctgtgcagtccaaacctgtgtttaactgctgaattaaaggtgcttccttctgctcattgatattacccatatttacaaacatgctagagaaaagcaactggtgtaaaacttgcccccactagagaaatggacaggaggtattaagtcacttgtaaagatagatagcagaactaagcttggtaaaagcccatgattgtttgtatactataaattagccaaaactactcttgcaaagcattttatgtcagaaatctggggcaatagtaactaactctggttgccacctaaaaatttcataacatgttaagaatcacattttttacatcatgcaaaccatccttacagagtgagcttaccttgtgatgagctttttaattgttacagttcattttagaagagtaatactttcagtcataatggtacctatggtacatagaattacaattttgctttttccacacactgaaaaatattgaagcaaaatcttaagaacttctaagaaaggtgcttgttaatcattcttggttttcatcatgttttgcggtgaaaatgactttaattagagtagaaatattgtctaacataaaaccaaaaagataaaacccaccacttatttacctgtacctcccatacatagagttcttgatgactaaagaaggatgacagtaattgggatgttctaaatacagttgtgtgtcacttaatgatgggtacatgttctgtggaatgcatcaggtgattttgtcattgtgagaaccatattgggtgtacttacacaaacctaggtggtatagcataccactcacctagactatacaataaagcctattgctccgagacaaaaaaagaaaaaaaaacggacgcagagtgatcatgaggacgcgtacacgaccacgaagacaagccagaaccagccagcagtcaccgacccactcacgaccagcagcacggcgggcgctaaactaccggggcccacacgctagcacagccattggtaagcgcgcccagtacggaactataaacaggcgccccgctcaacacggacggcaaactcgttcttccgaaaccttggggagcacacccccgagccggaaaaagtagtgacccgcgggggttaaacgc

SEQ ID NO: 107016 - DNA, 3983 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttatatacctgtgtttcccacaatcacagccactgtgacttttcaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaa

SEQ ID NO: 107017 - DNA, 4040 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccattttttgtctttttaaaaatatacatattataaatgtaatagtttgacacattaatgaccctaagacctgcgtatgtgaagcagctatgagtgctgtgatttgtttttaaaaatttttacacttcttgttgaaatatatatgcatataaatatatctatatctatatctatatctaaaacactcctggaccattaacgtaaattaaatgtcttaagagatatggagcccttttaaacttgtcatctttatgcaaggtgacatttataaatattccttcgagctttgttttcataaaatgtaaactatgtaacattatgtatagttcagtaatttgaatgtttgttcaatataatgaactagaaggaatgcaattttctgtagatgaatgaaccaaatggtaaccattaaacaattgcatttatatgttgcaatacatttcagaaggagcgttcactctgcagggaataaggtacctcctttagcaccttagtgcaattcattgtggtgctatttgtttttacctgaatgtttgttactaatcttcctttcatagaacctctattttttttttttctaaacttgagtttgagtccttgttatggtcatcataaggtaatggttagcatgtttaaagatattcctcttccaaatctcagcactttaaaaaaaaatccaaatttttaaacttgcttcctaataagtacacatcggtctgattattttgtttgtttttagtagaatatggatgcattggtgtcagttttaaaaaacaatacacatattttggacaaccctacatatttaatcctttcaaaataagataaaaacattttatatgctaacagaatatatttgttacaagttaaagtccagaagtatacacaagattgattactcctattattttttttaaatcacaggaaaatattgatttcattgtctccaaagtgataaaatcatgtattactcatttttgcacttaaaatttttcttatttattccaaggtggtttgaaggtccaagtatgaaaataaattagggggattaatgtataacagttataaagtatcatgttgtattaaagagcttacttagattgatgtttttaaaatgtatcctgatgaatgtctcaagaatgcatctgtcaagttttttagactgaccagtagcttaaacttttttcaggattttaggtaatttgaaaggagtttagagacccttattgaaaatatgatttaaaaatccaaagcataaaccgtaagaaaaattttaaataaacatctttaaagctgcatcttccatactgatacatgcattgcgtatgttgacattaaatacattttataatgaagaaaaataatcatagtaaaaaattgaaagacctaattactacgttacatggacctattgaattttgggggaacgtgttagtaaacccagactagctttgttgaatagaagttgatcgctgttatttaggaaatgggtagatcaaatgacttagagactgaattatcctatcagtggttacatggggttggagacactgaaaggcagtgatcactgttgcttctaggctcccttactttgtaggaatatggtatactttcaggaatatgctatatatgttttcataagtacagacaccttagggaagaaaaaaagtgggtaattgaagcttatggttgattaatttcctaacagcacagctatgaatattttgctggggtacactggaggtaggaagactactggaaatttttgcacttgaattttgtttttaaagcttttttctttaaagaatggtagaaacagattatccattccaaaatgtcttttctctgatcacaaagagcaaacaaatgtcaatatctcttatgatggtgaaaaaaaggaattaatcgatgcaaataaacttttcacagtattacttttaa

SEQ ID NO: 107018 - DNA, 2218 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattattgaatgttttagaagtagtagctcccttcaagcactttaacaagcttagagaatttgttcagatgaagcttcctccaggctttcctgtaaaattaggagtttcgatacgatgaatttgatggctccatctttactatacctgatgactacaaggaagacccaagccgttttcctgatctttaactgacgtggaaaaggatgccgtctaaccaaggaaagaaaatacagagaccctagaagtggatccaaatagaagggacaaatgctttcagtgaagaaaagggaattacacattgaatcgacacatcagtaatacgatacagtgaaatgggcctctaataagaatttcagcgagttttctgatgtgccatttggcttttaaattctttctaatgtatagttgccattatgacctaagactggttggaagatataggcgggttgtttaaatttcacttgtgaattttggtaattttttgtttttta

SEQ ID NO: 107019 - DNA, 1838 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgagccgattcgaagacagtctcttacacctcctcctcagaacactattacatgggaagaatatatatctgctgaaaatggaaaagctcctcatctgggtagagaattggtgtgcaaagagagtaagaaaacgtttaaagctacgatagccatgagccaggaatttcccttagggatagagttattatggactgtttggaagtagtagcttcctcaggcacttaaacagcttagacgaattggcagaataaggttccaccagggttctgttaaattgattttaccggggttccc

SEQ ID NO: 107020 - DNA, 1772 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaaggaaaagaagagaacatctcagtgaagaggatattcttcgaaataaggccatcatggagagtttgagtaaaggtggaaacataatggaacagaattttgaggtataatttttaattcttctaatttgtagttttctaagaagagaggggatagatttcattcttggtggcattcagtaagtatataaatgtactcacagcttttatttactgtgtgttacctttttctgtgaatcttcatttcgttgatgtcattattatgaagacaaaaaaatgtcttttgggatttttttgggaatctgtactttatctttgagtcttcatta

SEQ ID NO: 107021 - DNA, 1718 bp, Homo sapiens
gggggagctctcgcgagaggagcaagaggaagatggccgtgccctgtttttcggtgtaaggcagcgacggcggctgcgacggcgagactgagatcctggtgtcgtgggcacctgagttctagcttcccccagcgagcgcgcgtcccttcgtgcctaggcgagagccggctcttccccgggagatgcgtttgtcccaggctcgggggctcagtgggagttcatgctgcgctggaggctcttggccaccgctctaatcgccttgtgccgccgcagcgccagctccgtcgccagcggtgagcctcccgattcccccccttgcccctggcggcggcgatgaccggggagaagatccgctcactgcggagggaccacaagcccagcaaagaagaaggggacctgctggagcccggggatgaggaagcggcggctgccctcggcggtacctttaccagaagcaggattggcaagggcggcaaagcttgtcataagatcttcagtaaccatcaccaccggctacagctgaaggcagctccggcctcctccaatccccccggcgccccggctctgccgctgcacaattcctccgtgactgccaactcccagtccccggcccttctggccggcaccaaccccgttgctgtcgtcgcggatggaggcagttgccccgcacactacccggtgcacgagtgcgtcttcaagggggatgtgaggagactctcctctctcatccgcacgcacaatatcgggcagaaagataatcacggaaatactcctttacaccttgctgtgatgttaggaaataaagaatgtgcccatttacttttggctcacaatgctccagtcaaggtgaaaaatgctcagggatggagccctctggcggaagccatcagctatggagataggcagatgattacagctcttttgaggaagcttaagcagcaatccagggaaagtgttgaagaaaaacgacctcgattattaaaagccctgaaagagctaggtgacttttatctagaacttcactgggattttcaaagctgggtgcctttactttcccgaattctgccttccgatgcatgtaaaatatacaaacaaggtatcaatatcaggcttgacacaactctcatagactttactgacatgaagtgccaacgaggggatctaagcttcattttcaatggggatgcggcgccctctgaatcttttgtagtattagacaatgaacaaaaagtttatcagcgaatacatcatgaggaatcagagatggaaacagaagaagaggtggatattttaatgagcagtgatatttactctgcaactttatcaacaaaatcaatttctttcacgcgtgcccagacaggatggctttttcgggaagataaaacagaaagagtaggaaactttttggcagacttttacctggtgaatggacttgttttagaatcaagggagagtttgagtaaaggtggaaacataatggaacagaattttgaggtataatttttaattcttctaatttgtagttttctaagaagagaggggatagatttcattcttggtggcattcagtaagtatataaatgtactcacagcttttatttactgtgtgttacctttttctgtgaatcttcatttcgttgatgtcattattatgaagacaaaaaaatgtcttttgggatttttttgggaatctgtactttatctttgagtcttcatta

SEQ ID NO: 107022 - DNA, 797 bp, Homo sapiens
aaaagggataaaatcagcctggccttccattttttcatatgtctttacttatctgaagtaacaaaagtgtgatctgtcagtatttctaactttaatttatgtatggaggcaactgaagatattctcaagcacaaaagaattcaagaaacgtagcagtcgtaggacttttttcaaagaaaaatgctactacttaaaaaagaaatccatccaaccaaaagatgaaagaaattatagcataatgactaatatgatatagaatgctaagagatattatgaaattgtagttcagaaggaaagacagtataacctgaaattttatgtgagtcaagtttccctttaaagataagaagcaatcatttatcaaatatgcaggaaatcaaggaatattaagcacataagagccttttacacacacaataaattgacagtggaaatcagccacccaaacagtgaatctagttactagctttgagtccatctaaatatggacctaaaatcaaacaattgtgaaaattatggctgcacaatcaaaagttgtaaaccattatagagtaaaaagttaggaggaataaagtctgtaatttactcatccttagtatctggaagtcaatactactgtccaggtttgaagcatgtagttgaaaagcataaggacacaaggcaatttgaacaatgaaaacatttttttcttcttccatttttcagattattgaatgttttagaagtagtagctcccttcaagcactttaacaagcttagagaatttgttcagatgaagcttcctccaggctttcctg

SEQ ID NO: 107023 - DNA, 355 bp, Homo sapiens
tcgcccacagccactttagcagtatgtgtctgtgtgtgcatgttggagggggcattgttggatgtgtgggaagagcaagaaaatcacattctttttgcatcgctctgtaaactcatgaatcattggtacagctgtcccctggctactgggagcatggccgtgctttatgtttctttattgtgttaaggtgaaagatgcaataattttggtggtagaattttaacactttgaggactggagccagtaaataccttctaagtgcctgggattgtgcaaggtgctttacaaatataaactcagctctgaaagcaacccatctactacctactgttgcccattgcatagacaaagaaac

SEQ ID NO: 107024 - DNA, 251 bp, Homo sapiens
gattgcaagatccatgcccggccttgcctctgaacttttaaagaccattgtgagtattgattatctgtagaagcttacaagatttccttatctttggtattcaaaagatccatcaggttgaatgtctcagcatctgatgcgcccatccaatctaaagacatgccttagcacattaaaagtttgtatcggttgtctactgtattgtctcttgttctcatgttcttgaactcctgttagattgttggccatat

SEQ ID NO: 107025 - DNA, 410 bp, Homo sapiens
aaatgactctccccatttcaacaaaaatattagcactgttctacattttgatttttctcttaatatatcatggatgttatttgttgttatagagctgtctcattttaaaaaatggttgaattgtattacctttcatggctatatcataatttatttatctagctgtccactgagagacgcttagcttgctaccaatattttactgttaccgcagtgaatatctttacatgtgtcatatggcctatctgtaaaatatagttgtagaatacattttaaaaagtgaaattgcgaagttagaaggtatgtatgttttaaattttgatagctctcgctaaactgccttctgtagatattgtaccaatttacactcctaccaacaatgcatgagagtgactatttccccataactg

SEQ ID NO: 107026 - DNA, 874 bp, Homo sapiens
cccgtccccaccacaggaatcttgttttctaaccggccgtgctggtggacactgcgcaattttgcacttggagcgcttaagaagttcgggttgggtacgcggaccgtcgaggcgcgcgtcctggaggaggcggcttgtctgctagacgaatttcaagccaccattgcttcggcctggccgggagagcggaagggcctggtgtgggagagtcccttgcactgccaagacggggccactggaaggtatttgggtggaagaaagccagtaagcccatggggctggctgggggcaggaccacgcgttatgaccaccgtcctgttcctacccccaggagccccgtttgaccccgtgcggctactggataatgctgtatccaatgttatctgttcttgtcttcgggaaccgctatcgctatggggacccggagttcctgaggctcctgaacctcttcagtgacaacttctgcatcattagttccagatggggcgaggtgagagggccggccacaatctttccttggtgcgtccagccttatgccaaatcccgagtacacagacctacctacaatggatcattagaatgggacagattcctggaagagttctagaacatccagtatcaaagtcctagtccaatctccctgtagggaaactaaggcctagtggccttgtgcagggcccatgttgagacagaccctgtctctccagatgtacatttgcctgtccctcatggactggctcccgggcccgcaccaccgaatcttccgaaacttttcggagctgcgggtcatctctgagcaaattcaacgacactggcagatgcggcagccagcggagccccgcgatttcattgattgcttgaccagatgggtaag

SEQ ID NO: 107027 - DNA, 294 bp, Homo sapiens
tagtgattagccgatgcttatagaggcacaagggagggagtgaccacttaggagagtggcagaacactctctcggtgtttttgaaaatggttttgaaaactttcagcctgagggcagactgaaattgtgcttgaagagccacaggatagagtccaaggtgaccaaagctgccgggaagtgaggggggatattccaaagaggggagagccagagcgaggagtcccgaattctgtgtatcaactctgccctaatctcttgctgggagatgtatgtttttgttgttgtttttgtttt

SEQ ID NO: 107028 - DNA, 325 bp, Homo sapiens
attaagcacctaatgtgtgtactgtgctgggcactagcgatacatgaatgaacaagacattgtctgtgcctccaaggagcttacagttcagtacctcagttttcccaagtgaatgattataaacaagccatttttgtcatttgtaccctctgtgtctatcataattacaaatgaagttgtagttagctatttctacccttgctagtaggtccttattaagttactaataaatgtatattttttaaaaaagaatcagccatgcaatatttatatggcatagtgccttgcatacatataatacttttttttttttttttttgagatg

SEQ ID NO: 107029 - DNA, 319 bp, Homo sapiens
tcaaatctctgaatcaataattgaattaaacctggtgaacaaagaagagaataactgattgtatttaattcttttttaaaatttattattattatttttttgagacagggtctcattttgtcatccaggctggagtgcagtggcatgatctcagttcactgcagcttcgacttcctaggctcaagtgatcctcccaccttagcctcccaagtagctgggacgaccatgcctgtctaatttatgtattttttgtagagatgagggttgccatgttgcccaagctggtcttgaactcctgggcttaagtgatcacctgcct

SEQ ID NO: 107030 - DNA, 830 bp, Homo sapiens
gagcaggtgggccccggggccgggccgcgtggggttctccgtcctccgggtgcagccagacctggcggtgcagcggcagcaccagtgagaggcgaagggggcctgtgaggcaagggggacttccaggccctgagcatctcaagaaaacagccatgaagccccacacccaggtgccaggtgcagaggccaaggggtcctggggacaggagcggctgatctccctcagggtagagcagcagcgcgcccaggacagaaccgcctgccctgccgcgggagggggacagggacccaccctggctggggcccacagagtccagaggaccaggagctcgcccctgctccagcaggaggaagggagcggaggaacacccctcctgggacttgaagctggaattgactgagtacttactggatagagaccggtttaaactgagagagactgttcaaactggagcaaagtgaaaagctgttacccagataatcaggtcttacaattggccacgaaggtgtcttttcttttctttgccacaggatcatggtttttcccatttgttaattagaggattcagttgctcacctgagccacaatagatgcgggtagaaacgggacacctacagagatctgatttttgtcacgcttctggaaattcataggtaaatctcattcatggcactccactctctaccccaaatccctgtcaagtcccaatcccttggtgtgccctgctcctttcatccgtttaaccattccggagatacaatggtgagaactgcctgagaggggctggattccagagggagagctacccatttcgccaaggcgaacgccg

SEQ ID NO: 107031 - DNA, 1063 bp, Homo sapiens
taaagagatagagtctcactatgttgcccagacaggatttgaattcctgggctcaaggtatgcttctgtcttagctcctcagtagctgagaccatgggcacccaccactgtgcccagattcgggctttcttgtaaaaagcggatggatgcttgaaactattttctgaatccctttggctcccaaatgtgaatattctgggaaatatttttatccaaattagctgagtaatcgagtagttaggcacattttgaagactgaggcttgtcctttaaaagaagggcagcccacaaactgacttccttgagccaaaaattgttttaaaaggggaagtacagcccaaaacagtgattttaaaatatcaacaaaaagagtcaaattctgtgaaaatatttaaagagatttattctgagccaaatatgagtgaccatgtcctgtgacacagccctcgggaaatcctgagaacatgtgcccaaggtggtcagggtacagcttggttttctacattttagggagacatgaggcttcaatcaaatacatttaagaaatacattggttcagtccagaaaggcaggacaacccgacgcgaggcagggagcttccaggttataggtacgttttaaatttttctggttgacaattggttgagtttatctaaagacctgggatcaatagaaaggaaatgtctgggttgcaataagagttgtggagactgaagttttattatgcagatgaagcctccaagtagcaggcttcagagagaatagattgtaaatgtacttaaggtctgcgttgatgtgaatgccggcttgaggtataatgaggcatatctgacccccacttcccctcatggcctgaaacaatctctcaagttaaattttaaaagcgccctggccaaggagaaagtccattcagatggttagaggccttagaacattatttttggtttacaaaaacgttgagttgtgaacactgagagcctctgcccagaatgtaaaagagagaattcttgctgactgtggccgggcatgcatgtcctttcacttcctttttttttttttaaaa

SEQ ID NO: 107032 - DNA, 3564 bp, Homo sapiens
  misc_feature (1729)..(1729): n is a, c, g, or t
  misc_feature (1733)..(1733): n is a, c, g, or t
  misc_feature (1978)..(1978): n is a, c, g, or t
cagaagaaggattaagtatgacagcttgtctcaataatggaagtaaaaagcagagatcctggaaagaatctgccatccatcagaggaatttgtctgactttgtggtattgctagggggtgtatggttggagtattattttgatggtgctggatcaccctcatcacagtaaactcaagaacataggacagcttgtgaaataggttcttacttgtaaggtttgtatttatttttcttgcttttgaaatcttggatttaaatataataaaagtagatagcactgtcaatatttagactgtactgataactgtttaggtaaaggtctgttgacacttgtatcctagtaagactttgaaagtaaactttgtaaaataatgatttagtttgtcccttccctcttataaaattgaaagtgtaactcagaaagtaggctgtaagatcttcaggctgatgtaggatggtatactgcctaaccagtgaggatgacttttgggaaaataatgtggaagaaactaactgtggagcagcatcttacttatatttaattatagtatagtgaatatctggatcagcagatgatacttattttatagtagggcatttgcttttctctaattatctacttagaaaaagctgcttgcttttaaatgagagatttctggtcataaataagggggaggaattatagtttaaaagcaacacctcatgggagcaataaatgaactcacatagcagtagcttctttttcgcgagctttatctgtaggtctgtacttttaacatacattattttggataataaggaggaacatatgcagcagaaaaaagaggaggaagaagttcttaaagaagtaactgcacatttccaaattactttaactgaaactcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccctaccgtaaagtaaaaactctttcacaggacagtattttagaacttttgtgtatgcacagtggaaattacatgtttattaggaaaagagtagaaacctgtaaacagaatgactaaattggagcatcacttggcccaagtgtcagtggagtaggataagtaaagggatttctaggagatgtgtaccacttgtctcccatatgatgctacaagattgtcaatatagcatacagatatttttctcttatgcagtctaataatacagatttgttccctaaatactctgtatctcagatttctgtgacaatctgaacaatataaataggagaattgtgctatttgtgagaataaggaacctactaattacccatcaccaagtcacattgtttgtgtaatcaatgaagtaaaaagtttgtggaggactcaatagttgtcgaacctagtcattggagttattttataaattgatgtggaagttgtatgatggctaaataaaaaacaaataggtgataacctgcttatttgtttttattttttctttacttttagaggtctatacatagggtaagatttcaattttcaaaggatgcatccccttcctttattatgctttaagctagtaaaatatatatttaaatccttacttagtagattaaaattggaaatagaaagtgacaanttanaaattaataaaacagtaaatattactttatgcatatcaaaatgttattttgagttacaccttttcatgctacttttgaaaacatttttctttaagattttgagtatcttttaaaccattttcctctatgtttcaagaacatttcaaacttattatggaagctgcaaacttatagtagaatatatcacttggctttagcaattatttacttttgtttctagcaactcttgtttccatctatttttnagcaaatccaagatattatatcattttatttattactattcaaatatgcatcatgaaataagattctttttaagccataatcactgtactatttttactccaaaaggttaaacaattgctatgtaatcacataccttctcactgtactatttaaatatctgttacttcccttttccttcaggttgtttacatcaacatcaaaataaggtttatacattttattgttttaatatgtctcaagtctttttagtatataagcttcccccccctcttttttttccttggaatgtatttattaaagaaattttttaggcctatatagtgaacttttaaaattaaatttgttttatattataaagcatattatgaatatcatcagtttttttaaaagaatcctttaaattccattgttttaaataatggtattaaaaatgattaattttattttattttttattattttactctttaggatttatattattttaactgtattaaactctccaaatttgctatagaagtagcagattgggagaggacatgtgttcaagttgtactacttgtatgtcttgtttagatattacagtctttttcttttatcagaaaataattgaataatgataaaatcagttgcagattaagacagattatctgttgcagtcttctcaaaacttaatttaagtacattattttcagctagcatttcttccttcacatagaacctccatgtgtggagggatttcctaatgagtctattgtatgtacaatagcacttaatgacatagcttttaaataataacaggattttaccaaatgtttaatatgtgccaggcatcaagcaccttacacagtttaattattgcatagatttggacagcaactctgcaagttaggtatggtcatgaacctttgcagataaggaaactgtgtttcacaaggagaagaaattgtcctggatcatacaataagctaggatttgctccagaccatttttttcattttatcaggctacctacaattaaggaatttcagaagattttgtgaacaaaaaatgtccaggaattatgtgtgtaataaatgaatttgatattttgatctccttatccatctttttcttgataaaatatcagcttttttttttccaatgtagggcagaagcaagaagtacagatattttgatggggacagcccacgtctgatagggtgggacatggggcagcagttagagggttgtgctctttctagtgtgggatagtttgcaagatgatatgttgtagccacttctgcagtgacggggacagaaggagtcagtgttcttaactacagtggtagcagcagaaaagaagggtaagcagggttctagaaatttgtgttatgttttctccccactgtatttatttctttggttagtggtgcaagaaattctgttttcctgtagcaaattaataaagcgttcaaacataaggaattacgacaacagcttgtagatgccagacttcaacaaacagcacagctgataaaagaagctgatgaaagacatcagagagagagagagtttgtaagttctacttcttggaaaaaaaaaa

SEQ ID NO: 107033 - DNA, 412 bp, Homo sapiens
gcggccgcctactactactacgactactactactaaattcgcggccggtcgacgggttgtgctctttctagtgtgggatagtttgcaagatgatatgttgtagccacttctgcagtgacggggacagaaggagtcagtgttcttaactacagtggtagcagcagaaaagaagggtaagcagggttctagaaatttgtgttatgttttctccccactgtatttatttctttggttagtggtgcaagaaattctgttttcctgtagcaaattaataaagcgttcaaacataaggaattacgacaacagcttgtagatgccagacttcaacaaacagcacagctgataaaagaagctgatgaaagacatcagagagagagagagtttgtaagttctacttcttggaaaaaaaaaa

SEQ ID NO: 107034 - DNA, 2750 bp, Homo sapiens
  misc_feature (915)..(915): n is a, c, g, or t
  misc_feature (919)..(919): n is a, c, g, or t
  misc_feature (1164)..(1164): n is a, c, g, or t
tgctgttccagctgggcttgagtttcagttaaagtaatttggaaatgtgcagttacttctttaagaacttcaagcccagctggaacagcatgaaatacacaatgccaaactgcagcaggagaacatggaaatgggagaaaagctaaagaagctcactgaccagtatgcactgagggaagaggtaaacggcgtttggtttgtttatagacagctgctcaccagtagcaaaagctacaccctaccgtaaagtaaaaactctttcacaggacagtattttagaacttttgtgtatgcacagtggaaattacatgtttattaggaaaagagtagaaacctgtaaacagaatgactaaattggagcatcacttggcccaagtgtcagtggagtaggataagtaaagggatttctaggagatgtgtaccacttgtctcccatatgatgctacaagattgtcaatatagcatacagatatttttctcttatgcagtctaataatacagatttgttccctaaatactctgtatctcagatttctgtgacaatctgaacaatataaataggagaattgtgctatttgtgagaataaggaacctactaattacccatcaccaagtcacattgtttgtgtaatcaatgaagtaaaaagtttgtggaggactcaatagttgtcgaacctagtcattggagttattttataaattgatgtggaagttgtatgatggctaaataaaaaacaaataggtgataacctgcttatttgtttttattttttctttacttttagaggtctatacatagggtaagatttcaattttcaaaggatgcatccccttcctttattatgctttaagctagtaaaatatatatttaaatccttacttagtagattaaaattggaaatagaaagtgacaanttanaaattaataaaacagtaaatattactttatgcatatcaaaatgttattttgagttacaccttttcatgctacttttgaaaacatttttctttaagattttgagtatcttttaaaccattttcctctatgtttcaagaacatttcaaacttattatggaagctgcaaacttatagtagaatatatcacttggctttagcaattatttacttttgtttctagcaactcttgtttccatctatttttnagcaaatccaagatattatatcattttatttattactattcaaatatgcatcatgaaataagattctttttaagccataatcactgtactatttttactccaaaaggttaaacaattgctatgtaatcacataccttctcactgtactatttaaatatctgttacttcccttttccttcaggttgtttacatcaacatcaaaataaggtttatacattttattgttttaatatgtctcaagtctttttagtatataagcttcccccccctcttttttttccttggaatgtatttattaaagaaattttttaggcctatatagtgaacttttaaaattaaatttgttttatattataaagcatattatgaatatcatcagtttttttaaaagaatcctttaaattccattgttttaaataatggtattaaaaatgattaattttattttattttttattattttactctttaggatttatattattttaactgtattaaactctccaaatttgctatagaagtagcagattgggagaggacatgtgttcaagttgtactacttgtatgtcttgtttagatattacagtctttttcttttatcagaaaataattgaataatgataaaatcagttgcagattaagacagattatctgttgcagtcttctcaaaacttaatttaagtacattattttcagctagcatttcttccttcacatagaacctccatgtgtggagggatttcctaatgagtctattgtatgtacaatagcacttaatgacatagcttttaaataataacaggattttaccaaatgtttaatatgtgccaggcatcaagcaccttacacagtttaattattgcatagatttggacagcaactctgcaagttaggtatggtcatgaacctttgcagataaggaaactgtgtttcacaaggagaagaaattgtcctggatcatacaataagctaggatttgctccagaccatttttttcattttatcaggctacctacaattaaggaatttcagaagattttgtgaacaaaaaatgtccaggaattatgtgtgtaataaatgaatttgatattttgatctccttatccatctttttcttgataaaatatcagcttttttttttccaatgtagggcagaagcaagaagtacagatattttgatggggacagcccacgtctgatagggtgggacatggggcagcagttagagggttgtgctctttctagtgtgggatagtttgcaagatgatatgttgtagccacttctgcagtgacggggacagaaggagtcagtgttcttaactacagtggtagcagcagaaaagaagggtaagcagggttctagaaatttgtgttatgttttctccccactgtatttatttctttggttagtggtgcaagaaattctgttttcctgtagcaaattaataaagcgttcaaacataaggaattacgacaacagcttgtagatgccagacttcaacaaacagcacagctgataaaagaagctgatgaaagacatcagagagagagagagtttgtaagttctacttcttggaaaaaaaaaa

SEQ ID NO: 107035 - DNA, 411 bp, Homo sapiens
tgccccatggacttacacgtcaaatcaatgctaattgtttaaggcacctgttaggggttgaattttgtcccctcaaaatttgtatgttgaagtcttaacccttaaccttatttggaaatagggttgttgcagttgtgattagctgagatgaagtcacactggagtggggtgggcccctaatccagtctgactggcgttcttacaaaaagaggaaattgggacacagacatgcacacaggaagcacaccatgtgaagatcagagttctgtggccacaagccaaggagctaccagaagctcggaaggaacagaaccttccctggtgtctttagagggagcacagccatgcccacaccttcatcttgaaccttccagcctccaaaactgtgagacaatatgtttctgctggcta

SEQ ID NO: 107036 - DNA, 223 bp, Homo sapiens
caactgtacccatcataatgaaacagcaaaacactccagttaaaaagatctgaaaaataacagagggggaaaaaaaaaaaaccaagttacctgcaaagaactaaagattagactaatagatttcttaggagccacaatagtagtcagaagatagtagaatatcttcaatagtggagagaaaaataacatcaatttagaattgtgacattgtttcacccagtga

SEQ ID NO: 107037 - DNA, 1005 bp, Homo sapiens
gggcggtacggtccggaatgttgggatcatggccatcactgcctgcagccatggagagccatcaggacttccggagcatcaaagcaaagttccaggcctctcagccggagcccagcgacctgcccaaaaaacctccgaagcctgagtttggtaaactgaagaagttctcccagcctgagctaagcgagcaccccaagaaggccccgctgcctgagtttggtgcagtgtccttgaagcccccgccgcctgaggtcactgacctccccaagaagcccccgccgcctgaggtcactgacctccccaagaagcccccgccgcctgaggtcactgacctccccaagaagcccccgccgcctgaggtcactgacctccccaagaagccgtccaaactggagttgagtgacctctccaagaagttcccacagctgggggccactccgtttccaaggaagcccctgcagcctgaggtcggtgaggcccctttgaaggcctcgctgccggagcctggtgcgccggcccggaaacccctgcagcccgacgaactcagtcaccccgccagacccccctccgaacccaaatccggcgcattccccaggaagctctggcaacccgaggccggtgaggctaccccgaggtccccgcagcctgagttgagtacctttcccaagaagcctgcgcagcctgagttcaacgtgtaccccaaaaagcctccgcagcctcaggtcggtggcctccctaagaagtccgtgccgcagcctgagttcagcgaggccgctcagactcccctctggaagcctcagtccagcgagccgaagcgcgactccagcgcctttcccaaaaaggcctcccagcctccgctgagtgactttcccaagaagcctccgcagcctgagcttggggacctcaccaggacctcctcagagcccgaagtcagcgtgcttcccaagaggccgcggccggccgaattcaaagcgctctccaagaagcccccgcagcccgagctgg

SEQ ID NO: 107038 - DNA, 591 bp, Homo sapiens
ctgacattatggctgcaaagtgtccaggacagggcctggtacacattagatgctcaacaactgaggcttttctcttttccctctgttgtgcctgccagacgaagcccaggcttgacaggagaaagttcctggcttcctagaaaacctgcccagaacaataactgggaacataaactgctggagaacactagaccttggaagaagatcacgttactgaagtgtcagtcaggggataagaagtggagcaagatcctagcgcagagatggtgtggaggaatctgcctccccaggcctctcacttggggccggtgcagtgttcagggaaggcatctctgcttccgcaccagacctgcactggagaagtcaaggtggggaacgtgacagcgccagggtcccaagtgccagagccctcccttgcccctccccctcagggctgctccaccctgaccctgtgtcctacagcctcacacttctgccatcatcattattattatggcccctccctgaagctcagtcccctcaacctcacctgcccaccctgatttacctgggttgcctgggaggaggatgtgagaagggagtcagatgtgt

SEQ ID NO: 107039 - DNA, 752 bp, Homo sapiens
ctcccaaaatgctgggattacaggtgtgagccattgtgccaggctgggatttgagatttttgatttgactaggaataaccctgtctgaacaaacatctcctacctgattgcaataccatatgtcacccttataaacagaagcctctgtggaaaccaaaacgttcagtataaaagggaaaaacacagttatatactttttataatattgagcaataacgaccattttctccataaaattcgtgtttagctcccacacacatgaacataaggcaaatggcatcaggcttctggaatacaggaagggctgatggtgcggtagaagaggggaagagaggcagggccagatgttacggtggagactgtgtttgtatatgtttccttcagctcatctcagaattttttcatccatgtagggaaaagccgaggacagagtagtatgatagtcgttcttgctgtcactgaattaagaattttaaaattcaaagagtgtcaaacttgtgtttctttctttttactacttctgtctctctcagaatggaacctcacacccttcggtaaacttagaaaatatacgcctggcctcactccttattcacctacacttttagcagaatgaatgtcttatctctcaaatcaattttcagatttcaatgtggtatttctgcactagtcacagtctgatgtataacactgtggtaaaattgactatggcttgaacaacacagtggaacctaattgataactgcaggaca

SEQ ID NO: 107040 - DNA, 82 bp, Homo sapiens
gggtatctgtctcagacagtgctgttcctgatgacctttgtgaggaacattgggactaagatttgtagcactgtgtgaagtc

SEQ ID NO: 107041 - DNA, 671 bp, Homo sapiens
gcggctgtggggaggggaaaggggcccacgcagtgcctggagagtcccgctgcgggtcccacgcgggctggacctccccacagcgatgctgggatcctgggacgctctcaaggcttgagagcagtcgattgaagggtgagaatgggggaagtctccaaaaaaaccaaaaaacaaaaaatgtatgttggaggaagacaaggagcgcagtagggatcctgtaccatcaggctcgtgatgggatcggattgtgtgcatcggagtgtgtgcatatctgccagttctgacctcactttcctcttctgtaaaatgggcagagtggggttaactagattttactgaaggctccttccacggaaatatttcctaattttatttcctaattttatcaagtacctactaaaccaccactggctcctcgtcgtccaccctcctccctcactccacctgcagggccctcattgctgcattaacgaaaggcagagacgttgggggaagggggagaatatctcacactcctttaaagttagtaactggggcgcaccagggcgcacctgggtggaggggctaaggctttgggccaggttgcccaagcagagtggctggccctctttcctgcctcagatcaggaactgccagaggctttgggagctggtgttgcgcttctgtccacc

SEQ ID NO: 107042 - DNA, 795 bp, Homo sapiens
cgcggtggctcacgcctgtaatcccagcactttgggaggctgacacaggcagacaatgaggtcaggagatcaagactatctggctaacacagtgaaaccccgtctctactaaaaatacaaaaaactagcagggcatggtggcgggaggtacttggcagtctgaaacaggagaatggtgtgaacgtgggaggcggagcttgcagtgagccactgcactccagcctgggcgccacagcgagactctgtctctaaatacataaatacataaataaacaaataaaaataaaaagacccaaggaagcagcatttaaaaatattgttcctcctccaaatacatttcagtcttgagaaagaacataagacagtttttcttcatgtatttgcacatttcccatgaaatctcagacactgttatccttaaagaggaaggtaaaatcaagttcaacatcccatagggctcattctgagatatttgtgcttgtggcaagttatatgtagcagtgcgtatgattcttaaagatagttttttactcctggtctctggcaacagtttggggagcagctctttaaatagcaaagaataaaaacataaaggacagtttttttaaaatgccattaccaaatatgctgtagaaggagtcaaaactcttgagtagcaaatacagcaggatcctttatttattgagcttagataccagtgcatagcacagaaaaagttacatttgtactcacacatattcctccatcagtctagttcaactctgaagtaaaccaaagtaatatttataaaagaat

SEQ ID NO: 107043 - DNA, 457 bp, Homo sapiens
ggtggccctggcagtttctccccttcctcggggcttttctgttctgggcccctcctttccggaagcgagccccggagcacgtggagggagtggccgcggagcctgaggctgggaccttgagtggttctggctttttcccagggcctctccctgcagtgagagtgctgtgtcctctgcatcctgagtgtgtcctaaatcctgaaggtggggtgagggcacaccccgcacttctgtgtgtgtgtgtgtgtgtgtgtgtgtgtgtgtgtgtgtgtgtgtttttgagacagggtctcgctctcttgcccaggctggagtgcattggcactatctcagctcgctgcagcctctgcctcccgggctccagcaattctcctgcctcagcctcccaagtagctgggactacagatgggtgcccccacaccccactaatttttatatttttagtagagacagggtt

SEQ ID NO: 107044 - DNA, 241 bp, Homo sapiens
gtaaatcccaactaatattgtcaatagtaataatttatattgttacctgtactatatcctacattccagtctaaaattatgtgaatgtcataatcaatacatagtcttcctgtgagtaatgtcttccagctagagtattttgtttattacaattctgttgtccctccaaatagatgagcaaatatgtaatttcaaaatatttccataatttatgtattttttacgagtcactttctgatta

SEQ ID NO: 107045 - DNA, 284 bp, Homo sapiens
agtacttagaacaatgcctggcatatataagcactaaaaaaatccgtttaaaaaatccacttttaaaaaaagtgaatcttacatgttaaggctactgtaaagaaaacagtgtgatattgatggagagatagacacatagatcagtgaaatataatagagaaatatatcacacaagtatagccaaccgattttcaacaatgttgcaaaaaaaaattcaatggagaaaagatagtcttccaataaatagtgctagagcaactggatgtcaataggcaaaataatga

SEQ ID NO: 107046 - DNA, 394 bp, Homo sapiens
cagatggctatgtaccaaaaatgtgaattcttccattcaatgaaatgtaatgcagccttacttaccgtatgccaggcacctcgctgggcctgtggggtcccgggatgggtagaagtgacaaggcccctgtatatattccagtaggggtcaggggatttcaaagccacaccagtaggtaatgtagcggcagacagcattaagggctgggggaaagcatgaagccaagtgggggacagagagtgacagggtctacctggacatatggtggtcagggaaggttgtcctgagtccatctttgccaggagcaccagcagagccagggggacctcggggaccagcaggaccagaggctcccagagggaccttgttcaccaggagagccagggaaaggggg

SEQ ID NO: 107047 - DNA, 318 bp, Homo sapiens
gacctatacttcagaaatttggaaagaggagaagtgggacatgcccaaattaatgggacttggccactaacggggtttgaaggacaaaggagagggaagagtcagataggattagcatagcacatgactgcctaagagatgctcacaaaaataaatggctgaatgagtgaatgaacccagcggttttaaatctggaggcttaagacagtttttggtagctgagggagaacagaaatagctatgtttactgttaatatagaatatgtgttattctttgcactcacctttcccacctatattgcagacgccactgatagc

SEQ ID NO: 107048 - DNA, 327 bp, Homo sapiens
gggtggtggtgggtgcctgtggtaccggctactcgggaggctgaggcagaagaatggcgtgaacccgggaggcagagcttgcagtgagcggagattgggccactgcacaccagctaattttttgtgtttttagtagagatgaggtttcaccgtgttagccaggatggtctccatctcctgaccttgtgatccgcctgccctggcctcccaaagtgctgggattacaggcgtgagccaccacgcctggcctggttggagtttcttaagaggaggcagaaggccctttctggtctcattctacaggtaacatacccagtctaatttatc

SEQ ID NO: 107049 - DNA, 350 bp, Homo sapiens
cccagccaagagttcttaattttaacgaagtccaactttttgattatttctttcattgattgtacctttaaaaagccatctccaaacccagggtcatctagattgtcttctgtgttattgtcttaagagttttatagttttaccttttacatttgggtctttaatgttattttttgtgaagagtttaaggtctgtgtctagactgatgttttttgcttgtggatgtcaaattgttctagcactttttttttttttttttttttggagacagggtctcactctgttgcccagtctggagtacagtgtcgtgatcttggctcactgcaacctccaccttccgggttcaagcg

SEQ ID NO: 107050 - DNA, 445 bp, Homo sapiens
tggactggattgagggatgcctagctggttagtgaagcactgtttctgggtgtgtctgtgagggtgtttccagaggagattgacatgtggagtcagtggactgggagaggaagagccacccttgatgtgagtgggcaccatctaatcagtaatgggtgtgattagaacaaagcaggtggaacaagggggatactcagattgcttaccttcctccctctctcccttttgcagtgaggcaccttttctcctcctgcccttagacatcagactccaggttcatcttcctttggactctaggtcttgcactagcagcctgcctggggctctcaggccttcaccctcagacttattcaggactgcattgtcggcttccctggtttcaaggcttttggacttgaactgagccacactactggcattccctagcttacggatgacctattgt

SEQ ID NO: 107051 - DNA, 381 bp, Homo sapiens
cagagtgccacctaaaaataaaaaagaggtgcagaggggacacgtggcctcactgtgatccctatagattggtgggaccactgtaatctggtttatcctctgcccagttcaaatcatccccaaaattcatatggttattgtgtattattatacatccttttttggcaggtgctcaggttttttgactactctcctaggaatttaaaataacaggttatccaccttacaatcaggatccaggcccatgccaagggccaggcccctttgagacttaggctgggctgcaagagaagcacctatcacctattcactctgtgcagtccttggacacagtttgcttcctctaggagaaatctcagctgttgtagcctgggttgcctc

SEQ ID NO: 107052 - DNA, 691 bp, Homo sapiens
tccatggtgtgagcacctcctgcctcctgcctttcacctccactgcttggcctcttcaaaaccctctccatccaacctgctcctgtcaaatatgtctcttgtcagactgagcaatgtcagactgagagcatttatttcatgggcaggaagccagagtggctgctgtgatgtctgactgcacgtgtggtgcaagcacacaggggaagggggccttagattttctcaggtcaaggaggaccatgcggcctggccttctccacttagcgctgcatgagctcactgggctggcatcagaaagcccttccaaaacaggaagatacaagataaaacctccaagagagcaagggaggagagtgatgctccctctgggaagaatgcaccaagccagaaataaacaccttcatgaaaaatattttaaaagttaagctcaaaattgttttttaaatgcagctttactgaaaaaactataagctcagagtctctgctggggcaaggataaacaaagcacggttctttccaacaggaagccctcagtctagcaggacaggtaaatcaggcgagtgatttattttaaaagagaaagacaagggaaatgaacatttactgagtgtctacttcatggcaaagcttggagcagactatattacacacacatacacacacacacacaaattcacacacatctcatttt

SEQ ID NO: 107053 - DNA, 1643 bp, Homo sapiens
gccgggccaatgtcctatctcagggtttcccacgtcgctcgctccttgacggctgaccgacactgggtctgaggtgtaagcgctttccaggcccttccctggggcttggaggggaatggcgcaaaggacttttcttacaagcagagaggttggactcctgaaagcctggacagtgtcatcatcttcacctgaagagtggaaaaattcaagcaaagagtttctcaggaaatgaccaaataaaacatctggagtaagtcagcaggattcacagtgactccccccaaccagctggtggtgtttctctctgaaagcagcgcttggtaccagtgtgaactctcttccttcagaagtctcatcaggtgtttcagatgagttctccggaatttggacctcctactcttgggttgaaggtggacgtaatacgagggtctggtcccccataccttgaggactccgctgccatctgacaattacagacaatccaattgtcctcatccttgaggactctgctgccatctgacaattagagacagtccaaaacatgccacactttgatcctaaacacattcctggctttggtcacttttgaaaagtccctgagttatgagaaatcaataataagagtgttcaaaacctgaacactctttttagaaatacctgctggaactacatatatgatttatggggtactgtcttgtagtgtctgggaaagtagacccatctaacctggaatgatcataggcaacaatgaccaaaaatggggatcttttgatatacctaaagtaatttatttgtgcacaccattggaaagagctggttttagaaccagacatgtaaataagagactgacttccactggcacctaaaaacttctaaaagaaatcctgaaagaaaaagtcaccttcattcaagaggtaaacaaagggatatttgaaactatgttaaaagacttcagaggctttctccctttcacctccagaccctccttttccttccagccctgtgatctgaactcatccctttctgccgcttctcttggcttccatacatctcttaggcagagatgttttaaaatttcacaatgtacacatttccttctctcaggggaaatgaatttaaatttagagcagaaggaacaagcagaacaacaacagaatgggaataagactgctgagactataaaaatgcagatccaacaaaattttttctcaccaggtctagtgaatgacactgtgatatggtctggctctgtgttcccaacaaaatgtcatctcgaattgtaatccccacgtgtcgggggagaagcctggtgggagatgattggatcatggaggcagtttcccccatgctgttttcatgatagggagggagttcttacgagatgtgatggtttaaaagtgtttggcagtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgaga

SEQ ID NO: 107054 - DNA, 1632 bp, Homo sapiens
gccgggccaatgtcctatctcagggtttcccacgtcgctcgctccttgacggctgaccgacactgggtctgaggtgtaagcgctttccaggcccttccctggggcttggaggggaatggcgcaaaggacttttcttacaagcagagccactgcagttaccaaagagtatgtcgcttattgtctaagaggttggactcctgaaagcctggacagtgtcatcatcttcacctgaagagtggaaaaattcaagcaaagagtttctcaggaaatgaccaaataaaacatctggagtaagtcagcaggattcacagtgactccccccaaccagctggtggtgtttctctctgaaagcagcgcttggtaccagtgtgaactctcttccttcagaagtctcatcaggtggacgtaatacgagggtctggtcccccataccttgaggactccgctgccatctgacaattacagacaatccaattgtcctcatccttgaggactctgctgccatctgacaattagagacagtccaaaacatgccacactttgatcctaaacacattcctggctttggtcacttttgaaaagtccctgagttatgagaaatcaataataagagtgttcaaaacctgaacactctttttagaaatacctgctggaactacatatatgatttatggggtactgtcttgtagtgtctgggaaagtagacccatctaacctggaatgatcataggcaacaatgaccaaaaatggggatcttttgatatacctaaagtaatttatttgtgcacaccattggaaagagctggttttagaaccagacatgtaaataagagactgacttccactggcacctaaaaacttctaaaagaaatcctgaaagaaaaagtcaccttcattcaagaggtaaacaaagggatatttgaaactatgttaaaagacttcagaggctttctccctttcacctccagaccctccttttccttccagccctgtgatctgaactcatccctttctgccgcttctcttggcttccatacatctcttaggcagagatgttttaaaatttcacaatgtacacatttccttctctcaggggaaatgaatttaaatttagagcagaaggaacaagcagaacaacaacagaatgggaataagactgctgagactataaaaatgcagatccaacaaaattttttctcaccaggtctagtgaatgacactgtgatatggtctggctctgtgttcccaacaaaatgtcatctcgaattgtaatccccacgtgtcgggggagaagcctggtgggagatgattggatcatggaggcagtttcccccatgctgttttcatgatagggagggagttcttacgagatgtgatggtttaaaagtgtttggcagtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgaga

SEQ ID NO: 107055 - DNA, 1871 bp, Homo sapiens
gtctgtgatgcccttcattgtaaacatttcttgtgagccgcatcctactaatcttgtggcattggtttgctcgggaatgacgttcacccacagacctgaaaagtccttacagagttgggaagctgcgtgtcatcattttttcagttggcaaatctgcccactttgaactgacataattgtagcctaaaagttcagagagagagtagttcaggaaaaagactattccttcttcttagagggaacagcagccctgaaaactatgtggacatcataccagcttcttacaacaaaaggtgcacttggtctaaattatctggcagctctagataacgttctcatcaagtacctgtttgttgtagttatgcatatttattccttggcttagccactgcagttaccaaagagtatgtcgcttattgtctaagaggttggactcctgaaagcctggacagtgtcatcatcttcacctgaagagtggaaaaattcaagcaaagagtttctcaggaaatgaccaaataaaacatctggagtaagtcagcaggattcacagtgactccccccaaccagctggtggtgtttctctctgaaagcagcgcttggtaccagtgtgaactctcttccttcagaagtctcatcaggtggacgtaatacgagggtctggtcccccataccttgaggactccgctgccatctgacaattacagacaatccaattgtcctcatccttgaggactctgctgccatctgacaattagagacagtccaaaacatgccacactttgatcctaaacacattcctggctttggtcacttttgaaaagtccctgagttatgagaaatcaataataagagtgttcaaaacctgaacactctttttagaaatacctgctggaactacatatatgatttatggggtactgtcttgtagtgtctgggaaagtagacccatctaacctggaatgatcataggcaacaatgaccaaaaatggggatcttttgatatacctaaagtaatttatttgtgcacaccattggaaagagctggttttagaaccagacatgtaaataagagactgacttccactggcacctaaaaacttctaaaagaaatcctgaaagaaaaagtcaccttcattcaagaggtaaacaaagggatatttgaaactatgttaaaagacttcagaggctttctccctttcacctccagaccctccttttccttccagccctgtgatctgaactcatccctttctgccgcttctcttggcttccatacatctcttaggcagagatgttttaaaatttcacaatgtacacatttccttctctcaggggaaatgaatttaaatttagagcagaaggaacaagcagaacaacaacagaatgggaataagactgctgagactataaaaatgcagatccaacaaaattttttctcaccaggtctagtgaatgacactgtgatatggtctggctctgtgttcccaacaaaatgtcatctcgaattgtaatccccacgtgtcgggggagaagcctggtgggagatgattggatcatggaggcagtttcccccatgctgttttcatgatagggagggagttcttacgagatgtgatggtttaaaagtgtttggcagtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgaga

SEQ ID NO: 107056 - DNA, 1592 bp, Homo sapiens
gccgggccaatgtcctatctcagggtttcccacgtcgctcgctccttgacggctgaccgacactgggtctgaggtgtaagcgctttccaggcccttccctggggcttggaggggaatggcgcaaaggacttttcttacaagcagagaggttggactcctgaaagcctggacagtgtcatcatcttcacctgaagagtggaaaaattcaagcaaagagtttctcaggaaatgaccaaataaaacatctggagtaagtcagcaggattcacagtgactccccccaaccagctggtggtgtttctctctgaaagcagcgcttggtaccagtgtgaactctcttccttcagaagtctcatcaggtggacgtaatacgagggtctggtcccccataccttgaggactccgctgccatctgacaattacagacaatccaattgtcctcatccttgaggactctgctgccatctgacaattagagacagtccaaaacatgccacactttgatcctaaacacattcctggctttggtcacttttgaaaagtccctgagttatgagaaatcaataataagagtgttcaaaacctgaacactctttttagaaatacctgctggaactacatatatgatttatggggtactgtcttgtagtgtctgggaaagtagacccatctaacctggaatgatcataggcaacaatgaccaaaaatggggatcttttgatatacctaaagtaatttatttgtgcacaccattggaaagagctggttttagaaccagacatgtaaataagagactgacttccactggcacctaaaaacttctaaaagaaatcctgaaagaaaaagtcaccttcattcaagaggtaaacaaagggatatttgaaactatgttaaaagacttcagaggctttctccctttcacctccagaccctccttttccttccagccctgtgatctgaactcatccctttctgccgcttctcttggcttccatacatctcttaggcagagatgttttaaaatttcacaatgtacacatttccttctctcaggggaaatgaatttaaatttagagcagaaggaacaagcagaacaacaacagaatgggaataagactgctgagactataaaaatgcagatccaacaaaattttttctcaccaggtctagtgaatgacactgtgatatggtctggctctgtgttcccaacaaaatgtcatctcgaattgtaatccccacgtgtcgggggagaagcctggtgggagatgattggatcatggaggcagtttcccccatgctgttttcatgatagggagggagttcttacgagatgtgatggtttaaaagtgtttggcagtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgaga

SEQ ID NO: 107057 - DNA, 1538 bp, Homo sapiens
gccgggccaatgtcctatctcagggtttcccacgtcgctcgctccttgacggctgaccgacactgggtctgaggtgtaagcgctttccaggcccttccctggggcttggaggggaatggcgcaaaggacttttcttacaagcagagaggttggactcctgaaagcctggacagtgtcatcatcttcacctgaagagtggaaaaattcaagcaaagagtttctcaggaaatgaccaaataaaacatctggagtaagtcagcaggattcacagtgactccccccaaccagctggtggtgtttctctctgaaagcagcgcttggtaccagtgtgaactctcttccttcagaagtctcatcaggtggacgtaatacgagggtctggtcccccataccttgaggatctgctgccatctgacaattagagacagtccaaaacatgccacactttgatcctaaacacattcctggctttggtcacttttgaaaagtccctgagttatgagaaatcaataataagagtgttcaaaacctgaacactctttttagaaatacctgctggaactacatatatgatttatggggtactgtcttgtagtgtctgggaaagtagacccatctaacctggaatgatcataggcaacaatgaccaaaaatggggatcttttgatatacctaaagtaatttatttgtgcacaccattggaaagagctggttttagaaccagacatgtaaataagagactgacttccactggcacctaaaaacttctaaaagaaatcctgaaagaaaaagtcaccttcattcaagaggtaaacaaagggatatttgaaactatgttaaaagacttcagaggctttctccctttcacctccagaccctccttttccttccagccctgtgatctgaactcatccctttctgccgcttctcttggcttccatacatctcttaggcagagatgttttaaaatttcacaatgtacacatttccttctctcaggggaaatgaatttaaatttagagcagaaggaacaagcagaacaacaacagaatgggaataagactgctgagactataaaaatgcagatccaacaaaattttttctcaccaggtctagtgaatgacactgtgatatggtctggctctgtgttcccaacaaaatgtcatctcgaattgtaatccccacgtgtcgggggagaagcctggtgggagatgattggatcatggaggcagtttcccccatgctgttttcatgatagggagggagttcttacgagatgtgatggtttaaaagtgtttggcagtggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgaga

SEQ ID NO: 107058 - DNA, 349 bp, Homo sapiens
gcttctccttcaccttccaccctgattttaagtttcctgaggcctccccagccatgtagaactgtgagtcaattaaaccaattttatttataaattatccggtctcaggtagttctttatagcagtgtgagaatgaactaatacacactgatttattgacccactgtgagacagtaccctttaaatcttatcatgtctttaaaatgctaacattcagggaattagctaagcagcattccagatgagatcagatctaagacaagataaaatccttaaatgcttaaactgcctgctttggattccctgcaaaatttaccaaaaaacaaacacacaaacaaaaaaatgaaaa

SEQ ID NO: 107059 - DNA, 400 bp, Homo sapiens
tctctcttgccagttgtttgccttcagagttacagtttagaaacaacacttaaactgatatcctctgaagaaaaaaacagatacaaattcatgaagtcgtagttatacttaaatttcctccgtcacagagaaacatgttatttttagaaagtggatcccaaacctaactgatcagaatcccttgggggaaatgtttttaaaaaataccattacctgtgcactggcccagaaaatccagggccattagagactgcaaatgtctgagaatctgtgtttcctaaaaggcacaatggtgattctgatgggcagccatgtttgagaacctctgattgaattgtgcacaattttgatggtgctgctgttgcattataggtaattcaaagaagagcttctttttttt

SEQ ID NO: 107060 - DNA, 157 bp, Homo sapiens
attagacacaaaacacatgggatttaaatttattaacactagaatcctgttagaaccattaactgacaccagtgtatttaactctctgaccttgggacattagttaagggatgacaaccatcactatttattgttaatctgtaatgtgattttatgc

SEQ ID NO: 107061 - DNA, 226 bp, Homo sapiens
gctcgcgaacgtgttatccatagtcatatgtcaaaagagtgagcgatatttaatccttatacacacccatcttaccaaccacaaacaatctttcattctctcgtcctgaccctcattctgatgttatcctctatgctcactttgtatatgcaaactactctgaggtctgccgtatgtgagcatagaggataacacgttcgcgaggggatcctctaggtcagccccg

SEQ ID NO: 107062 - DNA, 399 bp, Homo sapiens
gtacattctcatggtgaagaacagcttcatcaaagctcagagcagcagagagtgcgcaccaggtctcaggaggcaggcccaccccacgggcgctctgccgggtcattcacatattctctgtgcagatggcagatggcacggtgccaggcttacagtttcatgctcactgtgctatgggtgtgaggctgcctcagctcctcccgaaggaatgaaaaccccctgcccagagtagaggggtaggggtttctagttttgggggcttcctgtaactggtgagatattcctgacacacattggtcagtttcactgttcgttggtcgttagtgtatagttccgggcatccagtgcgttcacagtgccgtgaacccgtgtccagtcccacacccctaacacaagctc

SEQ ID NO: 107063 - DNA, 269 bp, Homo sapiens
gaagtgctacacctacttttaaacaagtagatctcacaagaacttacgatcgtgagaacagtagcaaggagatggtgctaactattcatgagaaaccgcccccatgatccaaccacctcccaccaggccccacttccaacattcaggtctacgattcgacatgagatttggtggggaaacacatccaaatcatatgaccatgtcttatgagtcccaaggcagcagttcccaatcagtgcctaagagctgggtaggaacctcctgagtcc

SEQ ID NO: 107064 - DNA, 843 bp, Homo sapiens
cagaaacaaaagtttcttccctggaagggatgggagcagcaggggctggtggaggagctgccactgttttggtcacagaaccacgcgttctccaggtgaaaggtaaagcttcaactctgcacagtaatccagggaagcatcttcttcaacgggacgcgagccgctttctcctgtcgctgtgggtttcatttgtggcgacgtctctgcaacatccatttttccctgagtttctttctggccgtagcatgcaccttcgggggctacgaagttctgatgctcaggtactacaggagatccattgaactgaatctctggaagtggggcccaggcctctccttttcagaagctcagtgtgtgcttctgatgtacagccagagtttagagccatcaggctcacccagtcacggtgataccaactctccaaccagtgactgttcttggaacatgcagatcactctattctagacgtgaggcatgaggagaagcctgcaggaagcttctggaaaggagttcatcactcctaaggggaaagtgcctcgcaacagaccaacctggtgagggaggcggggggagcacatggcgcaacccaccctcctaccatccacattgcaaagccccagcgattcctgggcgtcacttttccacccccacccaccctgtgtctctgtggcttcgggcgcgagcttgtgggcagagccaacagacagagctggggacacctggggcccttcacagcgagatgccagactcaggcctttaccaactgcgcgtcactggtagaaaaggacattaggaacactaggtaaaaagcaaaacaaaaataaatctcacttggcatctttc

SEQ ID NO: 107065 - DNA, 1131 bp, Homo sapiens
cgcctcggctttctcatgatcagaaagttgaactactgaaaaatgcactgctcatccataaacctattagctttcaatgcttctatttttatataccagcattgagtttgttcattcctagaaacaaaggacataactttggactggacacattttaacttttcattctttttttttttttgagttatttcatttttatcacttttaaacaagagttgctgattttaacgacctttctttccccttggttgtatcctgaaagctatttcttatagagcaaggaatgttaaatttgatgctgtcaaatcatgacagtttagtgaaaaccttttttgcaacataagttgtaaaagcttttctgttcagaaggaatgtgaaatttgtttttaaaactactccaacaatttttgttttatcaccacttttgcagaagtctaggagttctggatattcacgttaaaagctgacaaatgtaggacttttttgtttcttttgcttgcttggtaaaaaaaaaaaattattattattattattattactatttgagacaaagtctcactctgttgcccaggctggagtgcagtggtgcaatcttggctcactgcaaccttggcctcctgggctcaagcaattctgcctcagcctcccaagtagctgggattacaggcacccaccacccaggcctggctaatttttgtatttttagtggagacggggtttcaccatgttgaccaggctggtctcgaactcttgatctcagacagtccacctgcctcagcctcccaaagtgttgggattacaggcgtcggtcactgcgcccaggtggcattgtattttaactaacaacagaatgttaccttgtgtacattgaataattaaaagttttttttttttttcttaaagtctacaacttaagacaaggtattttctaaacactgaacatattaaaagcagaccatttcaacagagaacatgtccattctgaaatagcctaacaacattatatactatgctggtgttgttttgttcctgctcagcaggtatttctgtaaatgaagtaatcagggaaggatcaaaggagaggtgaagtatgaaatcttattttattcaaaggtcaccgtctgaatcttc

SEQ ID NO: 107066 - DNA, 709 bp, Homo sapiens
tacagttgtatgaatctatacttttctttaaccaaaacagaacagtatcctttaaaacttaactgagatgttgaaggttaacaggtatctctgagaagaaagttgtctttgtgttttaaaacatggttggtagtcattcaattaccttcttctcatccttattctgcaatccatactgggttggtaactctgtaggtactggttttataattaatattatgtatttagtaggcaataaatttttattgtattttaataaattaaccttgctaactaatgtggaaaactataataccataagtgtagggaataatagagtcgataccttaaagattattaaaggcaaaatgtttttatctcaaaaaagtaaataagtaaaattcaaaaatgcctagagatcaaccctaggtggccgcttagggatggaatttctggggttctgctaatgaaattaattcatgatgttttctcagtttgcatacttataaatctatatggtgtcacagatgtgtctttgaaagtgcaatcccttttgagacctgtaatgaccgagcaggtatgagtttcggctgctcttctgtggcttcctttttttagtcttctcacggctgtcttaacacatttgctgttctgtcttctggggctataaacacccagagagtagaatctatatattatcgtttctccagctgtttcctaatcggcttaa

SEQ ID NO: 107067 - DNA, 806 bp, Homo sapiens
ttcaagcaactctcttgtctcagtctcctgagtagctgggattataggtgtccgccaccacacctggctaatttttgtgtttttagtagagacagggtttcaccatgttggccaggctggtctcgaactcctgacctcaggtgatccgcccgcctgggcctcccaaagtgctgggattacaggcgtgagccactgctcccggtccccctccctttcttccctttctcagaagctttgcagaaccatgcttcagtctatccgtctttaatactaacctgcaaccttagaacttactcatttctttggaaatgagttttgttgagaatgctaattgttatttaagacctcaaggactaggagggcctatgaggaggaaggtctttcaggtggtgcccagggcagggcatgttccagtgaggtagggaggtgtgccaggtgtgcatttatgtgatggtgtcagggctggatttgttggtgacccaggcactgtgatcactgtgagtaaacagctgggtgtatctagtgggtgtcctgggacttgtctgttggcagggaccttaaattgggacacctgtttccttttgggtgtgtctttgtagatgtatcttttcccaaaagaggttgaggattctggggaagactgaggacagggagggggttatcacctttatattggaattatcatagggagagatttattcaggatggtttactggaaccagtttattcctttggttgcttctgggttcaagtttaggacctgtctggtttccaaaggaatcagtgtgtttctggagagagagagc

SEQ ID NO: 107068 - DNA, 390 bp, Homo sapiens
gattcacttaattgtatccagaaataataggcttcaggcaagagttgatatccagctgcctactaatatcaccacagattgtttctttctcactctctgtcttttacagtagtagttttgtcctaagactgggtctgcttataaaatcacacaatgaaatgattgccagcaacaatcaggactacatgcttcttcattcacatcaagcagaaagaaaaggatcttttcctctctccaccatggaaataagtcctgggcttcattttggttgacccaaactgagtcacatgaaccaaccccaatggccaagagaatatcatgtgactttaggacaatcagcacctaccccaaaagttagaagtcaaagggtcagtgcccctcagacatcac

SEQ ID NO: 107069 - DNA, 4263 bp, Homo sapiens
gggaaagcgaggagccgcggcggcgtggagccggcgggcccgggcgggggctccccggagccctaccaccccaccctgggcatctacgcccgctgcatccggaacccaggggtgcagcacttccagcgggacacgctgtgcgggccctacgccgagagcttcggcgagatcgccagcggcttctggcaggccacagctattttcctggctgtgggaatctttattctctgcatggtggccttggtgtccgtcttcaccatgtgtgtacagagcatcatgaagaaaagcatcttcaatgtctgtgggctgttgcaaggaattgcaggtctattccttatcctcggtttgatactctaccctgctggctggggttgccagaaggccatagactactgtggacattatgcatctgcctacaaacctggagactgctccttgggctgggccttttataccgccattgggggcacagtcctcactttcatctgtgctgtcttctctgcacaagcagaaattgcaacctctagtgacaaagtacaggaagaaattgaagaggggaaaaatctgatctgcctcctttagtttggaagagacaatgccattttctcccttgagtaatcttgtgaaacagtccacagtttcatcatttgagtcaagtggagaactaacctttacctaccaaagccacgttccacggcccgaggcttaaacaggaccaatgagaggccacatccagctacgcaaagttactggacatgcggtctgcagtgcacattataaggaatggaacatgaaaatagtatataatcctagacctggagttgccaagttctgtcagactccatctcccccaggttcaatgatggatgataatctaaatcattagggcagcagtttctctggtaacggaagagaccgtccgccagatctgcaggctgtttctgctccaacactgcttgcttgtgagcatctctgcctcagaatggggttttgggttggagttcttgttttcctctgttctttcaagttgtctccaacgaacagaaaactataaacttactggggacaggatgtgtgctaaagggcacagcaagacactgtcttttgcttagctgaccaaaggggtcagcagggatggcgtggagtcatgctgtggaacttattctaggctgaatcctagggtaaggtggatcaactgaactgtcactccagagattttagaaatttgagtaaagaaacaataaggacctatacaatcatatgagaacaaaaatatgaaatcttgctagtgaagacgtattttttcttcttcccagcagccaggctagcaccagttctggcccagtctcctcttcttctggagatcacatgtttttcttctaaggttaggattgtgctttgactgcgaaaggaaacctcactgtttcctccttccagggactgaggtctccaagctagctgtggcttatgcagatgttcactgggaggacctgccagaatctcggcacttggggggagacctttactcccagtttggtgaccatgctgtagtcagctctatttccaatcccgacagtagcagaatggcattctacaacaaaaagaagctagttatgggagttaagtttttgtagttactggtgttgatcctgaaagcagactgagataacattaaattgctgcaactgaagaactgcagccaagaccttaattccaggaaagcacagaggacaaagttaattcaaaaagaggcgctagatcaaggtcacagcactgcctacacctgtttacaaaaagaatcaaataccactatgaataaggattcaggggtttttaatctactttccataaattaccaatatcactgattcaggaagatagtatctcagaatgaccagagcagcacagaaacaagctactctgacattatgggagcttcaaaattgtatcatgatacagaaacactccttagcactttaagaaagtgagatggaactgccagatttctggaaggagaaaaagtgtaggtatttgggttcattaatctgctcacttgaggactttgttttgaaaaagtaccttctgtggacaaggtattgtgctaccagctatacaaccctgacttcagagtttgcaaccttgccctgagtgaatcatgttaaagctgtctgagtctaaagcaccgtatcttggtgcagaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttc

SEQ ID NO: 107070 - DNA, 263 bp, Homo sapiens
cggacgcgtgggtcgacccacgcgtcgtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttc

SEQ ID NO: 107071 - DNA, 2091 bp, Homo sapiens
cggacgcgtgggtcgacccacgcgtcaacagataattatacagagatggaatgggacaaccgcagttttactacattctggtgtttggcctatatgagaaaccatcttctcacagattaagggctaagggcaaaaggggtgggaggtgtggaactagccttaatgagtttcccattcctgaaccaaaattcaaagtgagtgagatgtaaatcctgtgattttggtgaagaaaaaaacgggtatcttcatagcagcctaggaaaccttaaccatatctctaacaccacacagaaagaggctggaggagccactggacaaagcttctgtctctgtgtgtacatttataatgttctaaccaagtctcaaaccttgatgaaaaacacaaaatttttccataaacttatcagaagactcacttttctttctttcttggatagagaaaccattttctgacactaggtttacaatctcagtgtccttacaagttaagtcctaagctcacaggatcctccgagcatgtccatcacctgctctttggctaaggtggcagtgtacctctagatcaacctgggaacagtcacaagggagtgtgacttcttggccataataaactcactcgatagtgtttatgttattaatctgaatgcaacagaagacaaaagcacaggcatgcacacacacagaaccccaaaccactaaaaactacctaaacactgacttagtaaatagtaaaaaggtaatgttgggacttttaaaccttgaatccattagccaggcttgggatgaaaggaccatctaaaatcatgctagtctaaaccatgctcttccacacagctgtttaaaaaccactgggtatgaggaatatgctagaaagaaatgttaaaaatagattgttggctcacacttatttttctaataaataggaccattattactaccaggaaagtcttatttattttgcctgaaattggcttaaagaaagtctcatgacgggatgggatgggctgcgcttctcaatgaactctgaggcagaaatatttgccttggattctgtggattctttaaacctgtgtgctaataattcaaacaatgttgcattaattgtataagggtttttgtatagttttcaaacatctgtggtgtaatgatctttgttaaacatatattctgtaaagtgccatagtctttttttatgtgtagcatatttaaaaatatatatgtatattatacatacacaagtttgtgtgaaagatgtgcaataacaaaggtgtatgtatgttttgttgttttgttttggaaactggacaggagtcaaaacagggatgtttgtttctgttttggcaaaggagagttccacatttttgccttcatggcttattcagtaacccataattttaatgctacacaaatcttatgtgaagaaaagactggtatgaaatcattttttcctgggtctaaaataatcgctagtgttatgtcaaagttaagcccgcacgccaggcccagttaatgctagtctttcatgtgaaatgtgaagctgccatgttgccttttctcttagtaggataactagtagctggtacataatcactgaggagctatttcttaacatgcttttatagaccatgctaatgctagaccagtatttaagggctaatctcacacctccttagctgtaagagtctggcttagaacagacctctctgtgcaataacttgtggccactggaaatccctgggccggcatttgtattggggttgcaatgactcccaagggccaaaagagttaaaggcacgactgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccagattttgcaattcattcttattctttc

SEQ ID NO: 107072 - DNA, 465 bp, Homo sapiens
gatttcagcactaatgaaggaagagggccagagctctatttccctcctttccatcatcccattagggaaacctaatgactcctgggaaggaacatagcctattgtgttgactacgagggtaatagggacaggaactgtttcatagcaaaacaatcatgatacacgcatcactttctggaactggaatgaaaagtctgaccccctattttaaggcaagcaatgctgtcaacagggaaaatcctttgagtgaaacatttcagcagaattccacttaatgcctgatgttacaatgctactagaagggaacagtagaagggacagtggtgtagataggcctaaacaatggaaaattccttctctgagttcccacgacccaggtgtcaactcctggttcatttctttgtttctcccaatagagcttcttgagggatgaaatctgtcttattttacccaccatggcatccc

SEQ ID NO: 107073 - DNA, 379 bp, Homo sapiens
ggggatgctgccgttctgacagccacctgaactcagtatcccaaattgttcatcgatgtatcccagagcactgtagctaacttgcaagggtgccatggaatatttttaaatttcaagggaaatacactggcgtcattagattgctgtattagatcactgcattcctttcagtgatgtcatacctttgggaagctggattttcagtgcttgctctgataaaaagcaagtactgcctgaaaatcagtgtggaacaggaaatgaggctgtcagtgttcaatctgagtccagagtttgaaaagtatgcagtgcccaacaggcatccagtttttagaacttaaaatacttactaagtggtttggctcttactgcttaacggagg

SEQ ID NO: 107074 - DNA, 446 bp, Homo sapiens
tccaactatccctctgagagtaatgcttcaccttagttatgtctttgctattttcaaaacatttttattctcatggtcccccctacaaggcaaaaatcatgacgcccgttttacaggagaggacagagaggtgaaatggcatgcccaaggtcccccagctgtcaacaaagacacctcaacaggaggccagggctctgagagcctggtgcccgtctgctcatacctgccttccctctgccagtgagccccagtccattatcttgctccagcgtcatccccaaggtcaactccttactcccagctgggttcctcaagggcacctcaaactcaacatgttgaaactgagcttctctcctcctcccctcctggtggctctaatatacaaagtcgctacgtcttggaactctcagagatgcctttgacaaatttttgccatcccttctcta

SEQ ID NO: 107075 - DNA, 167 bp, Homo sapiens
aggatagcagaaaaggcctatatgtgtgatcagctggcctttccaggtggaatgtatatagaagttgtcctgtggtttgaggaagcagctactatttgcagagcctccctcatgtggttctgccacaagccttggctaaaggtagcctcacccgtgattgccagcct

SEQ ID NO: 107076 - DNA, 535 bp, Homo sapiens
cggcttatttacccctgcaacagggactttgcggtttgggtgttgtagctagaattgcgtgaaagccgtgagtgagctgtgcctggcacgctgtggattctagcgctggtagtttttggcttccacataaacttcagcctagagattgggaaggaaatatgtatgtaagggagttagggggtttggggtccttggcttgatagctttttggctggcttctcatcgatcttcaagtcaaacgtttagcgatttcttgaaagaattctctgactcggccccacccactcagccaccgaggtgattaaattatcacctcccaggggataggtatcatcttttgggaagagaagtttagcagattccacgaaatccttggccaacagaataggtgagctagtttcagcttctgtttacttgtagccttccagatttcagtctttgtttaaaatctaggtcccatttggtcagtagatgtttgtcagttcgcttacagtcgcaagagcggtgtaagacttaaatggtaaagtggtggaga

SEQ ID NO: 107077 - DNA, 414 bp, Homo sapiens
tctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaac

SEQ ID NO: 107078 - DNA, 935 bp, Homo sapiens
aagaagaggttgttctcacagtggggaggtttcagcacagccacctgctgaggccacagagaacctagatatgtgtcctgtaccctggccagctgccctgagctgtggggtgctgtgcatggccaagcaccgctagaaaagacacttattctgaatttcactcctcccatgccatcgttcagctttcaagtcttgggttagctttttgagataagtctccatggcaagggacaggaaagcatggccatgtccagttctgaaggccatctcaactctccctgtggtcgtgtatctgacttcttgcaaccaggaggaggcatcagaaatttccccagtacccagacgtcccaaggcagttgggcacacttgaactctgccccaagtacagtgcatttgggcacgtggcttaacaattttggacctcagcttcctcattttagaaaatgcaggggccaaagaggcttcctgggacttcatgactcaccctcagaacctaagatctcatgaaccaaagggctgcagctgtggagaggggagaatggggcagtgtgtgtgactacgaagctaaactgggggattcgcacccatttcgtgccttttcagcctccactgggacctcgaactccccaagtcccacaggtcttccaggggatctctcacctccccatgagtcataagccttacgtggcatgcactgcagtgggggtgttgttccctgcctggcatcagactcctgtgtttctgttcaccaggacccagggcagggggttgttctgagggtcacccacactccaagctaggtggtagagctgtccatcttggatctaacccaaatgcaggccctggtgaagaaaggtgagtccacagtgctccacagataatcagggcccgtggtgcccctgtgctcatcaccctgagaagcgtcactgctactg

SEQ ID NO: 107079 - DNA, 255 bp, Homo sapiens
cggcccgctcccctctctccacactggactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgcgtaagttgagtggagaggg

SEQ ID NO: 107080 - DNA, 1376 bp, Homo sapiens
ccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 107081 - DNA, 1169 bp, Homo sapiens
ccgacctctccacacggtgtaagaacagccccggagaactcctggatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 107082 - DNA, 1066 bp, Homo sapiens
  misc_feature (108)..(108): n is a, c, g, or t
  misc_feature (111)..(111): n is a, c, g, or t
  misc_feature (119)..(119): n is a, c, g, or t
  misc_feature (130)..(130): n is a, c, g, or t
ctgtgtcgtggttgtctcgtggtcactgtgtcgtgtccgaggatgcctgtcatgctgccggtaccgtaggtgatggagactgtctcgctggtggactggtaggtggangantcctcagngttgaagcggntgtggttggtgcaagcaagactggagcagtagactgagggcacccacaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 107083 - DNA, 1025 bp, Homo sapiens
ctgccctcctcccgggctgataccctggaagccaagtcctgcatgagatgaaccagggtggctctgggcctgaggctggcatccagagctcagtgaacatgacccgatggtgaacatcatctcggtttccccacccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 107084 - DNA, 116 bp, Homo sapiens
agcacaacctcaacccagccagaaagtacttcccccagtgggaggctcccaccctggtagatgaacagcccctggagaactacctggatgtgagtgtgcgggcaagtggtggggcc

SEQ ID NO: 107085 - DNA, 206 bp, Homo sapiens
cagtcgctgtagtgtaccacattccaaggaaggcagcaggcgctaaaataaccctcccttcgatggcatcctggggctggcctaccccagcatttcctcctccggggccacacccgtctttgacaacatctggaaccagggcctggtttctcaggacctcttctctgtctacctcagcgcacgcgactggggtcccgcgcacgcca

SEQ ID NO: 107086 - DNA, 1080 bp, Homo sapiens
ccttctccctcgagttgggacccgggaagaaccatgaagtggctgctgctgctgggtctggtggcgctctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtgggaggctcccaccctggtagatgaacagcccctggagaactacctggatatggagtacttcggcactatcggcatcggaactcctgcccaggatttcaccgtcgtctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagagggtaccaactcgagtcgtatatgtat

SEQ ID NO: 107087 - DNA, 1026 bp, Homo sapiens
tacatatacgaactcgagttccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 107088 - DNA, 1026 bp, Homo sapiens
caggctgctgatggctgagcagctgaccaccatgtcgccatctgagttctcgctggctccgatgacgctctggatgttggcaatgggtctggttgggccgggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtcttcaccatcaatggagtccagtaccccgtgccacccagtgcctacatcctgcagagcgaggggagctgcatcagtggcttccagggcatgaacctccccaccgaatctggagagctttggatcctgggtgatgtcttcatccgccagtactttaccgtcttcgacagggcaaacaaccaggtcggcctggcccccgtggcttaagcctaagtctcttcagccacctcccaggaagatctggcctctgtcctgtgcccactttagatgtatctaattctcctgactgttcttcccaggggagtgtggaggtcttggccctgttccctgtcctaccaataacgtagaataaaaacataacccactgaaacaggttttgtgga

SEQ ID NO: 107089 - DNA, 451 bp, Homo sapiens
catttagtgggaaatgaggtcctcttcatctgaatgattcaagtaaggtttccccaaggaagtaccatgaagaaggcagccaggagtgagagtgcacaaaatgctcagggtgtggtggacagcccagaacctctgcaggaggagatgtgtgtgtgagtgaggtggacagggtgtcataagcaagaaaggcagctggagaaggtcacttagagccttgagtgtcatgctcaggaaccaggctggccccacctgcatggacctgtgcagtcacacagggccccaggcttggcttaatgctctgctgtcaccgtcctgaaattcctaacatttttacctttgaactggtgtggggatgttttgtttgttttgtttcgagacggagtttctctcttgttgcactccagcctgggtgacagagcgagactccatctctaaaaaaattaaaaaagaa

SEQ ID NO: 107090 - DNA, 697 bp, Homo sapiens
gtagtattgtgactggaacttaaccttggtatttaaataaaatttatttttaagtagctgttgtataaaaagaaaacattttaccatgtagaggaaacagtatgacaaaaagcgtattagaatgggagtctctgtgacacctgggttttgggctcacttctagcaataactagcagcaagatccttgtttatagcatactctagtttggtgaaatagtggagtgatttttttgacagaaatagttctcaaataaagattgcaaaaggaatggcttcagattatccggaagaaaagtagattgtttccccttctatatttcatcattcactccaaaaactggagataaaataattagtacagacttttgatttgaaaagaaaatctcagggttagacgtagtacttaatttatttaacaaactcttataaaacactgcatacttcatatagtcttaagcactttagaaatattaaccttaaaaaaattttaggtgtggatgtgatattgaatattctgcatagttttctaataaatttacttacacagatgttcatacatatgtgaatttaatatattatgcattatatattacacccaccacttaacatgtttacagtttcaaaacaactaaaattttagaattccccctagaatatttccattagaatccagtttaactcctgtagagaacagatg

SEQ ID NO: 107091 - DNA, 694 bp, Homo sapiens
gagccctcaggggaagacaaaatgacacagagtgctaagacaaggcagggcaaagttccacgctccagtggcctgtcttgtcctctcaggaaagtgcccaatggccaaacaccctgctccatcactttggggtgcctggactcctccctcctctagtttctgttttcctccctacaccctccccaaaggtagacagcatggctggcctgggctgataaggtttcttcttcctaaaacatcgatcacgtggcctcagaaattcagagcccgagggagtgataggtgactctggccctctgttcacgaacaaactttctttgcaggattgggtcaaccatggggtctgatttggagatgcttcccttctctgtcagctgctcatgtctcaaatgaagagccttttgtgatgaccatgtatggaatagtgtctgaagtaccactgcactgtacctgtctttgcgtctaaacatcactaccatcatcacgggacaaaccgcccatctcagtggtgtctggcagtgagctgtgcgtatgtggatagtgctggtgtttttagggttgaaatttttagtttgttctttatttgagctaatgtttctctcctctgagggtcagggtaatttccctgccttcctctttctctcaaatccccacctcccagtggctgtcctgataccttgaggcacctgcattc

SEQ ID NO: 107092 - DNA, 700 bp, Homo sapiens
cagaatctgggtaaattccttaagaactctatgcctcacttttctcatctgaaaattaggttgttgtgaggattaaatgcactaatttaagtaaagtgctcagcccaggacttggagtaaaacaaacacttaataaatattattattattttcttcggattcagggcaatcaatacgacatcagtaaacttgctgttctttaatacaatggcttttaacctttgttacatattaaaatcaccagggaagcattttaaaactcatgatgtccagaccataccccatactaattaaattagaacagtcatttttagaaattcctaactgatttcaatctataataatttggggaataagtgttacgagtaacttagacaataggtgttatacccagattttcttctgagggaaactattgaagcagggtctatagcttcctcctttctattctgagccaaatgactctgggaaatgatgaaggtcctgatgctattttatcaaatgttgttgcatttcctgcttacatagcttgcactttctttctcattttaagtttctttggcagttatctgaatcttctccaggtaggcagtgccaaacagagagcacaagtgaagacaatataagaaatctggattctctgtgttatttgccagtgctgtagtttgggttcaggggcagaagaaaatacaatctatca

SEQ ID NO: 107093 - DNA, 447 bp, Homo sapiens
gggtgcagcctggacctccagggttcaagcagtcctccctgctcagcctcttgagtagcttggacaacaggtgtgtgccaccacaccaagttaattttttaagtttttcatagagatgggagtttctccattgttgcccaggctggtctcaagctcctgggctcaactgatagaactgtcttgtcctcccaaagtgctggaattacaggtatgagccactgtacctagcctgatctttttaaataaatgattttagacatgaatgttggagcttgagatcagataattggttagcagaattacttaagtcatagccagcctgtgacttgatctattttgggagtatcctttgaaccagtagaggaatccactaaaagggctatatggctgtcattagtagaaaaacaaaaggcaaaatgtgttggcaattttagtttcatgctttaa

SEQ ID NO: 107094 - DNA, 412 bp, Homo sapiens
gcagataaggaaactgaagcttagagaaatttaagtaacttagcagagcttgctggtctgttggaaaagtagacattccacttaagtctggctgctcttagagcctctctcccacacatagagcctctctcccacacactgtgctacctcccactcctcctgtgtgccctcttccactttcaccactgccagtaatgacggtgctcccactctctgcatctttaagccaccttcagtacaaacatcctgcctggcaagcaggagagggattactgccccattcaacagacacgacgctgagggccagggcaggaaagtgacctttgtggggtcgcatggctagtcctcatcctaactgctcagagcattctcaggacactctccccactgatcatggccagggcttcccaaa

SEQ ID NO: 107095 - DNA, 1005 bp, Homo sapiens
aaaacttgcaacaccacttaagcttagatgtattatttgtacctcaacattttttattttgttgagaaagtttaaggttaattggcagcatatttctaatagtagatagaataatgtctgttttataaacattgacatcctacattacatgtgtcaaccctgaaaatctgagacggctctcagattttttagaaagtttattttgccaagcttgaggatgtgcgcccatgatgcatccttaggaggtcctgacaacatgggcccaaggtggtcggggcacagcttggtcttacacactttagggagacatgagacatcaatcagtatgtgtaagatgtacattggttcagtccagaaaggtgagaaggccagacagggggcttccaggtcataggtaggtaagagacaaacgatttcattcttttgcattgctgattaccctctccacgtgaggcaatcaggtatgcatttatctcggtgagcaggtgggtgtctttggatagaatgggaggcagatttgccctaagcagttcccagattgacttttccctttagcttagtgattttgggtccccaagatttattttcccttcataaggttttcctatgagtattaattattcattgtgtattttattacacaaataaggcacagatttttaaaaaatcatcaacttcgtggctacctatatagacataattgcatagaagttcaactaaatttgcaaacatcccagaatttgggtttccaataattcttagtgattctttaaaaggtaaagtatttttttcccataaaacatagcaacatgtaaaatcacccgtagaatgtcccgccatttttgtttttctagtttcctcattttctgcaaagcctcactgaggagattgactttgaatatccttttacactcttctgttttagatagcattgtggtaaaacattgaatcatcatggtcataagttctgtccacattctttctttctttgaatattttttccca

SEQ ID NO: 107096 - DNA, 676 bp, Homo sapiens
cactctcttatttgtgctctcacttccttaaattttaaccttcttctcgtgctgcactttctccaggtatatgagaaacctctccatttttcactttcatctgtattgctctttgcctgttggcctcaatttctcccaccacaagatgagcccctaaacgtatctaagaatgtggcctcaagaaccccagtgtggcaatcccagtgaaaagccttttcccagtactcatctttccatcctggggaaggcatgggattgcttttggttggttgtgtacctaccctggcacacagcactattatcagagtgatgggccaatacaatatatggtgagggaaatgaggttccatgattggccccatcagtcacaaggatggaaaggcagtttcctaagacagatgtatcaggcaggagagaggagctatacaatgtcaacagggaaagtgtaatataaataatcatgaactaataatagagggttagccactaagggataaaaagaagtctaaaggttacagaaacaggtgaatggataaacaaaatgaaatgttattctgccataaaatggaatgaaattctgatacatgctaccccatggataaaccttgaagacattatgcaaaatgaaataagccagactcaaaagggcaaatattatatggtgccacttatacaa

SEQ ID NO: 107097 - DNA, 591 bp, Homo sapiens
attaacagcaatcctatttaaagaattaacagcaacccttctcagattccttaaaaaaatagaataggatggaatactacttaactcattttatgaagtcaacatgatacaacacacaaaaactacataccagtagttcttaggaatatagatgcaaaaatcctcagtaaaatactggaaaacagaattcatcagcatagtagaaggattgtacacaatggccaagtggaattaatcccaagaatgcaagggtagttcaatataatcaaagtcaatcaatgtaagacatcttactaaggcagtgaaagaaaaaatgatcaactcaactggtgctgaaaaagcatttgatgagattcagtacccttttatgataaaacagtcaaacttggaatagaaaggaacataactaataaagggcatctgtgaaacaccaacagctaacatcatacttaaagattccatgctttcttcataaggtcaggaacaagacaagggtgttcactcttaccacttccttttagcattgttgagaaagttatggccaggataattagtcaaggttttttttttttttaaaaaaaaaaaaaaaaa

SEQ ID NO: 107098 - DNA, 3174 bp, Homo sapiens
agcagtagttctcccgggcgcctagcgggatcgccagcgcggcagtgggggcttccgcggctgcaagccagcgggtcctgtgagggcgagcggaggcggagaaagggcgcgggagtgagagagggtgagtcagccactgtctatgcaataaagggaggcctcaccgcgggatagggctgaattcagaagtgcggcccgtgccgcagtctgttccaggacgcggcttgtcttagcgtcagcgagggaaggttgaggaggagccagagcctggtcctgcagcctttctcgccgtcagcgcccgtcgccatctccaccatgcagtcccgggaagacgtcccgcgctctcgccgcctcgccagtccccgtggtgggaggcggcccaagaggatttccaagccctcggtttcggcctttttcacgggtccagaggagttaaaggacacggcccattctgcagccctgctggcacagctcaagtccttctacgacgcgcggctgctgtgtgatgtgaccatcgaggtggtgacgcctggcagcgggcctggcacgggtcgcctcttttcctgcaatcgcaacgtgctagcagctgcgtgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaatgtgcagcgcctgtacgcggcctccgacatgctacagctggaatatgtgcgggaagcctgtgcctccttcttagcccgacgtcttgacctgaccaactgcaccgccatcctcaagtttgcagacgccttcgaccatcacaagcttcgatctcaggcccagtcctacatagctcacaacttcaagcagctcagccgaatgggttcaattcgggaggagactctagcagatctaaccctggcccagctgctggctgtcctacgcctggatagtctggacatagagagtgagcggactgtatgccatgtagctgtgcagtggctggaggctgctgccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctatgacccttactcgggggacatttacacaatgccatcccctttgaccagctttgctcacactaagactgtcacctcctcagctgtctgtgtgtccccagaccatgacatctatctagctgctcagcccaggaaagacctctgggtgtataaaccagctcagaatagttggcagcaacttgcagatcgcttgctgtgtcgtgagggcatggatgtggcatatctcaatggctacatctacattttggggggacgagaccctattactggagttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgttaggccttttgcagtttgactctggctttatttgcctttgtgctcgtgtttatccttcctgccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttggttagtgccacaaggaatttaactttttgatttgtataatagaaaactgaactaggaattgttagcggggttttgaaggatgtgtactttccttcaaaataaagtggtagattttcaaaattttacactagtcagttctttatattctaagttaaatgtagtttgtaaaattattttggttttcttctacaaaggaaaaaattggatttatatatataaggttactgcataatgatttcattttgataatgtgcagaatggcctcataagctcacagaaagtaaaaaaaaaaaaaaaaaaaagaaaaaatcaggattccactgttttaaaagaaatctcagtttttattttggaatataaaatgtgtatttggtatatgtgaccaattttctatcccaaaaaacacccattcttagtaatgtcatgaattaaacacccttctaaaccaaaaaaaaaa

SEQ ID NO: 107099 - DNA, 2994 bp, Homo sapiens
agcagtagttctcccgggcgcctagcgggatcgccagcgcggcagtgggggcttccgcggctgcaagccagcgggtcctgtgagggcgagcggaggcggagaaagggcgcgggagtgagagagggtgagtcagccactgtctatgcaataaagggaggcctcaccgcgggatagggctgaattcagaagtgcggcccgtgccgcagtctgttccaggacgcggcttgtcttagcgtcagcgagggaaggttgaggaggagccagagcctggtcctgcagcctttctcgccgtcagcgcccgtcgccatctccaccatgcagtcccgggaagacgtcccgcgctctcgccgcctcgccagtccccgtggtgggaggcggcccaagaggatttccaagccctcggtttcggcctttttcacgggtccagaggagttaaaggacacggcccattctgcagccctgctggcacagctcaagtccttctacgacgcgcggctgctgtgtgatgtgaccatcgaggtggtgacgcctggcagcgggcctggcacgggtcgcctcttttcctgcaatcgcaacgtgctagcagctgcgtgtccctacttcaagagcatgttcacaggtggcatgtacgagagccagcaggccagcgtgaccatgcacgatgtggacgccgagtccttcgaggtgttggtcgactactgctacacgggtcgtgtgtctctcagtgaggccaatgtgcagcgcctgtacgcggcctccgacatgctacagctggaatatgtgcgggaagcctgtgcctccttcttagcccgacgtcttgacctgaccaactgcaccgccatcctcaagtttgcagacgccttcgaccatcacaagcttcgatctcaggcccagtcctacatagctcacaacttcaagcagctcagccgaatgggttcaattcgggaggagactctagcagatctaaccctggcccagctgctggctgtcctacgcctggatagtctggacatagagagtgagcggactgtatgccatgtagctgtgcagtggctggaggctgctgccaaagagcggggtcccagtgctgcagaagtcttcaagtgcgtgcgctggatgcacttcactgaagaagatcaggactacttagaagggctgctgaccaagcccatcgtgaagaagtactgcctggacgttattgaaggggccctgcagatgcgctatggtgacctgttgtacaagtctctggtgccagtgccaaacagcagcagcagcagtagcagcagcaactctcttgtatctgcagcagaaaatccaccccagagactgggtatgtgtgccaaggagatggtgatcttctttggacaccccagagatccctttctctgctatgacccttactcgggggacatttacacaatgccatcccctttgaccagctttgctcacactaagactgtcacctcctcagctgtctgtgtgtccccagaccatgacatctatctagctgctcagcccaggaaagacctctgggtgtataaaccagctcagaatagttggcagcaacttgcagatcgcttgctgtgtcgtgagggcatggatgtggcatatctcaatggctacatctacattttggggggacgagaccctattactggagttaagttgaaggaagtggaatgctacagtgttcagagaaaccagtgggcattggtggctcctgtccctcattccttctattcctttgaactcatagtggttcagaactatctttatgctgtcaacagtaagcgcatgctttgctatgatcctagccacaatatgtggctgaactgtgcttctcttaaacgtagtgactttcaggaagcatgtgtcttcaatgatgaaatctattgtatctgtgacatcccagtcatgaaggtctacaacccagctaggggagaatggaggcggattagtaatattcctttggattcagagacccacaactaccagattgtcaatcatgaccaaaagttgcttctcatcacttctacaaccccacaatggaaaaagaaccgagtgacagtgtatgagtatgatactagggaagatcagtggattaatataggtaccatgttaggccttttgcagtttgactctggctttatttgcctttgtgctcgtgtttatccttcctgccttgaacctggtcagagttttattactgaggaagatgatgcacggagtgagtctagtactgaatgggacttagatggattcagtgagctggactctgagtcaggaagttcaagttctttttcagatgatgaagtctgggtgcaagtagcacctcagcgaaatgcacaggatcagcagggttctttgtaaatagtattttgagacactaagatgtttctactgctacggaatgtattttaaacacatatcgtttctttttcttggaaaaaaagttgattaggaccacagatttggtttagaaagggtaatattttgaaatactacaaggtttagacagtccatgaaatcgacctgtttaataatttaccatcctgaaagtccagaattaaaatatggaagcaagaactatataattgattaggatgcttggtaggtttttttcattgttcaaatattcattgcacagtggattgttttgattagttagtatgctttttttttaattaattcagtcttctgttaatttttaagttttggttagtgccacaaggaatttaactttttgatttgtataatagaaaactgaactaggaattgttagcggggttttgaaggatgtgtactttccttcaaaataaagtggtagattttcaaaattttacactagtcagttctttatattctaagttaaatgtagtatataagaaatctcagtggttatcttggaatatggaatgtgtatggtaggtatatatgaccaggtttctatcccgaatacacttactcctagtcgtcgcatacttctattccccc

SEQ ID NO: 107100 - DNA, 762 bp, Homo sapiens
ctccactctgttccacccaggaatgggggatgaaatgttggggtgaaaagggcagggaatttgtgatcgtggtagcaccatggctggattcaggcaacagtgttttttcattcattcattctgaaaaattttattgagtctctttaagtcaggtcttgtgctgaggaatcaatgatgaaccaacactgagacattccctgtgctggagaagcctgaatgtgtagaaggctctaccatctagatttgtggtttccagtggaaaagacatcttgtttcctaaacaacaattggccacacactggagacacataacctgcctatgaactggagaatcctattgaaatcttagaggaagtttgagattttcctcagataggtgtttactattcaagttggcacgaataggttttgttaaaacccattttctttctattctgcctctatctggtacaagatagaactaaagaggatataaagcagcaaggtacaatttgaaatcaaatggcaacaatggaagataatggtcttggttcaacccaatgcccacctgaaatcacttttattaaggacgaccaactggaacaaaattgtatattagtcttctcatgataatttcaagtgtgttttgatttgagaatttctttatgaaagtcttcaaaaatcccacctcttaatccatggaattttccctggagtctgaaaattccccaaatctttggagacttgatggttattcactggtcaagggctctataaaagtgt

SEQ ID NO: 107101 - DNA, 502 bp, Homo sapiens
aaagacttgtgaattagaggattgatcagtaagaaatatccacagtgaagcaccgagaaatgaaaggatgaaaaaaacatagtgtaatggagacaagggacataatagaagggttaagacacatacaattgggttataccaaaagagagggctaggagtgtcataagtgctaaaagtcaaggacagtgaaaaaaatatttaattgctagagaaaaaagatactaggttaagaagaataatgggatcaacagccgatttctcaataggtaacagaaagaggatttgtcaccagcaggcccattctgaaagaaaaaggaagttcttgtagcagaaagaaaataatcccatagggaaacaaaatttcaggaaggaataaagaacagtggaagagtaaatgtgaaagtaaatatatatgaatattgactgcagtgtaataaaaatatcttgtttaaagatatatgtagcttgaaaatttaagataaaatggtttaaaagttaggag

SEQ ID NO: 107102 - DNA, 376 bp, Homo sapiens
  misc_feature (2)..(2): n is a, c, g, or t
gnggaaccaaagtccttggctcctggtccaccccaggtttaggagtgcaagtgggtgtgatcttggctcactgcaacctccgcctcccgactactcgggagcctgaggtaccagaatcacttgaacctgggaggcggaggttgcagtgagccgaggtcatgccagcccaggagacaagagtgactccgtctcaaaaacaaaaaacaaaaaacattgaattttactaaggaaaattaatcacaggaattctgttcatatgagatagatcttttgttatgcttgaggtagtgggacataaggagtatttgtttagaaaaaaattttaaattaagtggtattttggataagagagatatcagtattttttaaatgtgac

SEQ ID NO: 107103 - DNA, 282 bp, Homo sapiens
tccacccaccaagaccacaaagcccgattccaccacctctctgccacccctccccctgctacatccttgctttcttctctacccgactcagagccacagccttgtagtcatattggctccctggtgctctcacgtgccaccacgttcctctgccctccaaagcgctttctggcaaatcccagagctgattaaatctaactccccatctcctctgccccaagcagctgtacacagctggaggagatgcagaatcctgctgactggtcccaccgtaaactcttg

SEQ ID NO: 107104 - DNA, 241 bp, Homo sapiens
tccacatcatatcccctctcgccaaggtaataactctccaacaattctctactctccattctgcatcaataattttcccttctatactggatcgttactggtgcaacaaacaaatatgttattgtttccatcaattaaaaacaaaaaaacttgctagggtcccactttcctctccagctaccctcaaatttcctgctctctgggttatccagcctccatgaaggcccctaatggcccccac

SEQ ID NO: 107105 - DNA, 408 bp, Homo sapiens
aatgctacataataaatcctttttctttaacattaattttgtgatattccttatttcatttctactaataaaaatagacatgttttgtttgcattttcccttgttttaatttgtatgtttgtactactttttagatgcttaaactatacataagctattatctattgttcctagtaatcttaggggagtggtctgaaaaaacatcaagcatagtaattgtctgggtagacagatttcagaatttttaaaatgctttaatttatttattagcatttttctttgtatgggctgtgtacttttgcttcaaaaaccattgttaaaaagtatttcttttgtaatcaatctaaataatagactttttttacaggcaaaatgaaagaggaggaagtctgggttttatgaatagca

SEQ ID NO: 107106 - DNA, 408 bp, Homo sapiens
atagtatagtggtgactcagtattttttaaattaatccaccaattatgcttttttgtaatatggtaataatttccctgtttaaactatgattctatccagggcctattgttcctttactaaatggacctaggtggtcgaacttgagttcttgtttctacatgtgatcatttttctttctctttccctgtttaccatttgttttgcttctttaaatgtacctacctttagcaccctccctccaacacttttcttttttttgagacgggagttttgctcttgttgcccagactggagtgcaatggcgcgatcttggctcactgaaatttctgcctcccgggttctagcgattctcctgcctcagcctcccaagtagctgggattgcaggtgcctgccaccactcttggct

SEQ ID NO: 107107 - DNA, 429 bp, Homo sapiens
  misc_feature (159)..(159): n is a, c, g, or t
  misc_feature (186)..(186): n is a, c, g, or t
taagaatattataacagaatcaaggtctgaaggcatcagagggtatttttagactcttctatggggtcatggtctgctctttttaggtgtggatttcacatattaaaattcagtaactagttttagctccaagacgaagccatcgcgttgttgttgtgngcctagtggtggacctaggaaggaggnggagttgacttgtggggggcgggttcggggggtgtgtggggtgggggtggtggtgggggtgggtggtgtggggttgtgggggtgggtgtgggtggtggtggtgtagagcataatgaaaaaatgctatgggtcccaaattataacaaaggataccttttaattttaattccaatattgttttcaataatatttcaacatgtttcctgttgtgccctggtattcttaggcagccagttgtaaaag

SEQ ID NO: 107108 - DNA, 338 bp, Homo sapiens
aaataactcaatgtccatccttatacataaatggataagtaaattgtggtacatccatacaatggaatactactcaacaatgaaaagaaatgaagtactgatacatatagcaacatggatgaatctcaaaataattttgctgagtgaatgaagctaaattttaaaaatcaccatatttttaaaaaaggaagaaaaaaatcaccatataattccattatacaaaattctagaaaatgaaaactaagttatagtgacagagagatgatcagtgcttacctgggcagtgggtagagagggacatgagggagggatttcttttggaggtgatggatatgttt

SEQ ID NO: 107109 - DNA, 741 bp, Homo sapiens
ggtaaaggaagtttccctaccttggcaaacttcccatttgcttgcttaggtgctgaggcttgttcattctttccttgccatagctttttccttcccttccttccttctgcctgccaggctcatctcctaattctacttctacccataaggacaaataatgatcacaccacttacctaattgcctggccctagttctggtcccaactataatcagaaatgtggattctggaatggcagtgaggagcgacgtggactgtatctccagtaaaacaccataactggtaatttagaaaaccaaaaacaaccatttaaactacacggaatttgtcttaagaccactcaggaatttagagaaacatttattcagaaaaatcaactgagcctttctgagaacagtgagagtctgtaacatttgacacacaaactgctaccctccccacccccattttggtccactctgagagaaactccactgtgggctgtgaaaatcacaagatggaaccctgtccctctccagttctcagtctatggtgacagcttttccctgagagaggcacgatgccactattcttaacttctctccccctgccagtcctgtgttcctgaagctggtttcatgtaagtatagttgagaagtgtgtttgggtgtggacctccttgaatttattcttggagtttgttgagtgtgctggccttgtagattcatgtctgtcttcaaattttgaagttttggccattatt

SEQ ID NO: 107110 - DNA, 362 bp, Homo sapiens
aactacatcagcctagatgagggtctctagtggcatgtcaagggactctgtctttggccatatcttattcagcccttttatcaatgactggaatgaaataggtgagggaagggtgaacatttattgagaaactcctgtgtcagcaactattgccaatattttacaaagcttatttatcttatccctcacagcctgactgtaagagaggttgtattaccctttcacagaccaggaaataaatatgtaaccaagggcaagcaacttgcccaaggtctcacagcaattaatgcaataagatttggcatccagactgggatctgaaggctggggctctgtgtcacatgtggcactaaactgtctta

SEQ ID NO: 107111 - DNA, 113 bp, Homo sapiens
tgtctggaggcgcctctcaagtcagccagcgtggcaggtcaggaggagacagggcaggggacgtgagggcaggggatgcagggtggagggcgcacagcgggctgggtgagtac

SEQ ID NO: 107112 - DNA, 1159 bp, Homo sapiens
  misc_feature (692)..(692): n is a, c, g, or t
  misc_feature (797)..(797): n is a, c, g, or t
  misc_feature (940)..(940): n is a, c, g, or t
  misc_feature (1152)..(1152): n is a, c, g, or t
  misc_feature (1154)..(1154): n is a, c, g, or t
  misc_feature (1157)..(1157): n is a, c, g, or t
  misc_feature (1159)..(1159): n is a, c, g, or t
gatgtatttaaattatttctgaatattttactaaaaagggaatgtgggaggtcagtgcatttaaaacataaagaaatgaagagctagttcaaaccctgggaaaatacactatatcttaaactccatgaaagaaggtgaggctgcaaacagctaatgcacattggcaacagccctgatgcctatgccttattcatccctcagaaaaggattcaagtagaggcttgatttggaggttaaagttttgctatgctgtattttacattacttattgttttagctgtcctcatgaatgtcttttcactacccatttgcttatcctgcatctctcagccttgactccactcagttctcttgcttagagataccacctttcccctgaagtgttccttccatgttttacggcgagatggtttctcctcgcctggccactcagccttagttgtctctgttgtcttatagaggtctacttgaagaaggaaaaacagggggcatggtttgactgtcctgtgagcccttcttccctgcctcccccactcacagtgacccggaatctgcagtgctagtctcccggaactatcactctttcacagtctgctttggaaggactgggcttagtatgaaaagttaggactgagaagaatttgaaagggggctttttgtagcttgatattcactactgtcttattaccctntcataggcccaccccaaatggaagtcccattcttcctcaggatgtttaagattagcattcaggaagagatcagaggtctgctggctcccttatcatgtcccttanggtgcttctggctctgcagttattagcatagtgttaccatcaaccaccttaacttcatttttcttattcaatacctaggtaggtagatgctagattctggaaataaaatatgagtctcaagtggtccttgtcctctctcccantcaaattctgaatctagttggcaagattctgaaatcaaggcatataatcagtaataagtgatgatagaagggtatatagaagaattttattatatgagagggtgaaacctaaaatgaaatgaaatcagacccttgtcttacaccataaacaaaaataaatttgaatgggttaaagaattaaactaagacctaaaaccataaaaatttttaangnaancn

SEQ ID NO: 107113 - DNA, 122 bp, Homo sapiens
tgtcatggtctaattaaacaagctaatttatctggaggagttatagatattttgtctcatggtcagtgaatgctataactttaaggtttgtgtctatctcctataccattccctcattgtat

SEQ ID NO: 107114 - DNA, 354 bp, Homo sapiens
aattcatgaactacagaaaaagagctgcaaagggaatgagccgctgaagggtgatctccgaaatttaaactatactgagcagttgctgttgggcatctaggataggattcaactttttaaccgctccttgtaaatcaaacccatagctttcaattcttttaaagacagtctgtggtcctcagaagtatggtgcagttcagcgtggctgatgtgagccattcttgattgaaaggatttcttacagaaaagctaatggaaacaggttaataggaaacaggctaatggaaggtgtttttagctaggacaaatgcagggactcatattaaaaagatactctgggacagtattggggag

SEQ ID NO: 107115 - DNA, 527 bp, Homo sapiens
cgggaggcagaggttccagtgagcccagatcgtgccattgaactccagcctgggtgacagagggagactctgtctcaaaaaaaagaaaaaagaaataggtcgacctgggccccagccgcgctgtgctttcatgagtttccgtcagccctgttccatatcctggatctgtgcatgccaagggctatgtgggaagatttcatttcaggtctcttgagaacagggtcagatggaggaggcaggctttatttcagatttggacaataggcctgagggcttgatttatagagaaagtctcagaggaaaataaaggaaaagaaaatacttcccattctcctaaagtgttcacatgtctcctgtgcagtgagtggggctgagattgcaggcttttttttttttttttttttttgaagtggagcctcactctgttgcccaggctggagtgcagtggcatgatttcagctcacgacaacctctgcctcccgggttcaagcaattctcctgtctcagcctcccaagtagctgggatt

SEQ ID NO: 107116 - DNA, 428 bp, Homo sapiens
aggcagatgtttgaggcccccaccagctctctcctcagtgactagttcacatcatccctccagcctcaaaccccaaactgagacatattccccagtcctctctctcatcttccacacacagtctgcctgccagtcctgaccgttccccgctgtcagccacttcgcatctcccacttctcctcctctccatcattaccactttgttcaagccactgtccctgctcctgaacagctgccatggtcttttcattgtccttcctgctttcgtcatcctttccagccttctctccacacagcagacagaatgacctcacgagcatatcttgttcagtcctcacaacgaccctgtgaggtaggtactgttgtcatgcctgttctgcaaaataggaaagtgaagcacaaaaacatcaggcgccgtgtatccgagg

SEQ ID NO: 107117 - DNA, 640 bp, Homo sapiens
taattttttgtatttttaatagagccaaggggcttcaccatgttagccatggtggtctcgatctcctgacctcatgatctgcctgcctcggcctcgtaaagtggtgggattacgggcatgagccacgtgcccagccttcatgtgtattttagacaatgaaaatgatgttagacaaaaaagcaaattcgagcagttttcgtttttgagttaaaaatgggttgtaaaacaacagagacaccatatcagcaatgcatatggttcaggaactgttaacttacagtgcagtggtgattcaagaagtttttttgttgttgttgtttgagatggaatcttgctctttcaggctagagtgcagtggcatgatcttggctcactgcaacctctgcctcctgggttcaagccattctgcctcagcctccccagtagctgggattacaggcacgcaccaccatgctcagctaatttttgtatttttagtagagatggagtttcaccatcttggcccaggctggtctcgaactcctgacctcgtgatccgcccgccttggcctcccaaagtgctgggattacaggcttgagccgctgtgcctggcagtttcaagaaattttgcaaagggaaggaaagtcttgaaaatcagga

SEQ ID NO: 107118 - DNA, 283 bp, Homo sapiens
aactcctaacctcaggtaatccgcctgcctgggcctcccaaagtactgggattacaggcgtgagccactttgcctggcctaattctttaaacagaataaacggcgtatgcattgctttccatcttgttaggttcactgcatacagaatacttttctgtaagaaaataggagctgtttttccaagggtgcaatgtcacatgtgattctgacttgagtttccgtgtattttaccctccccttctgccctcctaacgagaactgtgagttggatgcagaagtttct

SEQ ID NO: 107119 - DNA, 233 bp, Homo sapiens
caggtactgggtgactgcctggctgaggaaaagttaactagacacttggggaaaggagatccaagggagtaagaggcaaaatgcctttgcatgcttttcttccgatctctttttctttctctccttctcactctctcccttccttcctttcttcctttctctttcttttttttttctcttttcccccacctctctgtctgcctccttccttccctcccctcccctcccttccc

SEQ ID NO: 107120 - DNA, 915 bp, Homo sapiens
tcgtgccactgcactccagcctggtgacagagcaagactctgtcataaataaataggaggcaaatgtagaatgggtcggtcagttaggaggcattattcatttttaggttcatccttgtcccttgcaatcttgcacatggtaggtatttaacaaaggcttgctgagtgaaggaatgtgtcttctgtaatttgtattcatggtaaaagcaaggctcctattctccaacttttagaatttttaagtaaaggatattgtgtttaaagatggagctctcttctatttagcgtttttataagttgtggcaatatctttaatagtctctgaaattcttgtaggaagtggaaactgagcatactatttcagctgctaaggagaccattcatggcagctgcaagaacatgcagatgaaaaactttcctttttatttgcaaaattgatacttttcctactgtcagtatccatccctcagtaagattggatgaacaaatcccaggacctcttctccagggcatgtggacagcaggcctgcatgtgtccaggcctgctgctgcctgcatctccaaggactagtagcttctttgggaagtgttacctcaggagtgcagcttgtgcgttcattcaacaaattttgatagtgtcttgccaatgatttatcccagttcttcccaaatttctatcgttcttttacctaatctcattattttagctgcattatagtattatctgtgctatcagttaatatttttctccaaggtgacttttaaaattaaatttattttataattatattattgctatgagtggaaaacttgtatcacttgctgtaggaaaataaaactgtaaaagtaaagtacaatgaaaactaaacaatgttattaaccagattctgatacttgtgaaacttcaggacctat

SEQ ID NO: 107121 - DNA, 523 bp, Homo sapiens
  misc_feature (21)..(21): n is a, c, g, or t
ctttttttttatttgagacanagtctcactctatcacccaggctgaaatgcagtggcgtgatcaggctgaaatgcagtggcgtgatctcggctgactgcaacctccacctcccaggttcaagcaattctcgtgcctcagcctcccaagtagctgggattacaggcgccagccagcatgcccagctaattttagtacttttggtagagatcgggtttcgccatgttggctaggctggtctccaactcctggcgtcaagtgatccacctgcctctacctcccaaattgctgggattatagatgggagccccaagcctggtcttatgtaccttttgacaagaaagtaatttaaaagcagtcggacacagtggtaaatatttctttcttttttaaaattatctcatgcaacagatgaaagaagtatatatttctttatctgcactttgtagttgaaagaaaccaagctcagagaggttaaatatcatttccaatgtcacagagctagtattgcacaactaatcagaa

SEQ ID NO: 107122 - DNA, 379 bp, Homo sapiens
gtcccctggtggtggttgggaagggaggttgggtggcaaagtcagccttagttgtaaaccactgcttagatgaaggagccaaaaatagccagctggcacatatcagctgccaaggctttaaatcagttttaactaaaatgagtctttgcagaattccttcagggtattgactgtgatcctaatgcatgcaaacatggaaggatcatagcagagagccaggaaagtaaagatgtccacagactttgaggccagaggtgttcgtgacttggcatatgcgtatttatgattgcttttacagaacatacaaggtaaatttacccttcgctagaccctaatgcactgattttttttcacatttctttagagccaaatggctaag

SEQ ID NO: 107123 - DNA, 349 bp, Homo sapiens
ataatagttaatagcagggagcctttgttatcacaagatctggttttgaaaaccagtttcttaatgtgtattcttaggcaagttactaaacttctctaaacctcattttctttatcctcaaaatgagattacgtgtgtaaagtacttagtatactgtctgacacatagtaagtgttctataagtggtggctaaaaagatgtgttaaactttttgtctgtgttagataatatctgtgatatttaaagtagacatgtatagtgacataaaatattagtatgtatgagagcagatgattgacactttccacagttacataccaagtcaaaaagtgaaaaatctataactact

SEQ ID NO: 107124 - DNA, 313 bp, Homo sapiens
gtacaagcaattcttatgcctcagcccccaggtagagtagttggaactacaggcacgtgccaccatgcccagctaatttttttgtatttttagtggagatcgccatgttgtccaggctggtctcaaactcctggcctcaagtgatctgcccacttcagcctcccaaagtgctgggattataggcctgagccacctcgcctgccctccaaatgtgattttgaatttgtcaatttcttcttttatttgttgtgctttactttaaataacatatgtccatcttcttacaaaatatctatttctagcaatgctgttg

SEQ ID NO: 107125 - DNA, 582 bp, Homo sapiens
aactcccccactttattttgtgctatgtagatctggccatacttgcattagtgactgtcttgccttaaccacacttaagcaacccacaaatttcttctcagattggtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatata

SEQ ID NO: 107126 - DNA, 658 bp, Homo sapiens
aactcccccactttattttgtgctatgtagatctggccatacttgcattagtgactgtcttgccttaaccacacttaagcaacccacaaatttcttctcagattggtttcctagattacttatgatactcatcccatgtctcaataagagtgtcttttctttctggatgtgttctcttactccctcttaccaccatactttttgctctcttctcctgcaagcgtagtcttcacagggagtggcttcctgacatttttttcagttatgtgaatgaatggaaaccaacagctgctgcaaacactgtttttccaagaaggctacactcagaacctaaccattgccaaccatttcagtattgataaaaagctgaatttactttagcattacttatttttttttccatttgatggttcttactttgtaaaaatttaaataaatgaatgtctatactttttataaagaaaagtgaaaataccatgacactgaaaagatgatgctatcagatgctgtttagaaagcatttatcttgcatttctttattctttctaattatctaaaattcaataaaattttattcatataaaataagttgtcattaattatcaatactaacgagtatgtcattttaaaacttagtattctctttaatgttacaaga

SEQ ID NO: 107127 - DNA, 410 bp, Homo sapiens
ttcttccatagaaaaggatgaagtactgatacatgctacaacatggatgaactctgaaaacattatgctacataagtcataccagacacagaagtccacatattgtataactctataggaaatgtccagaatagacaaattcacagagacagaaagtacattagtggttttcaggaggtggaagaggaaggaaaggagagtaactgctaatgggtagagggtttcttttttcagtgatgcaattgttatagaattagagtggtgatggttgcacaattttgtaaatatactaaaaccactaaaggtgcacttaaaaataatttttaaaatctgtttaaaaatacaatgaatagcattttttaaaatgcaatgaatagcattttacatatgtcatttcacacaataaatta

SEQ ID NO: 107128 - DNA, 249 bp, Homo sapiens
caaagtgctgggattacaggcgtgagccaccacgcccagcccatacaccccctcattcttgactgtgctgctctagtggacgaaacagccccaaagcattgctcagttgggagggggtggagggagtccagcctgggtgtgtgcaaaggagtcacccaggaaattcgccgcgggatctgcccttacagatgcactcgcctggggccaagccctcggtggctggggcaggttacccagaggcccaggggc

SEQ ID NO: 107129 - DNA, 322 bp, Homo sapiens
tggcttttttccttctctgctggtgacttgcagcctgccagcgctgtaggctttggcgggggtcggggggacaggataaagtgccccatcttgtgctttgcaagcacttttcaaagggtcttctgctttttttccatgtcttgggcggcgagtgggtagttactgttagggttccagaaaaatccatgtggagtctccaccaggtagtgaggtcctctcctgggcagaggtgccttagagctgccctggttccacctgcctctccttccttcagggcggctgagggacagtaggctcccccagcatctggctgctggggcca

SEQ ID NO: 107130 - DNA, 981 bp, Homo sapiens
tttctagttgcttctaaatgttatggttggctcaagccagctggagttcagaataacccgagagcttgggataacatgtctgtgcgtgtgtgtgtgtgtgtgtgtgtgtgtgtgtgtgtgttttgtgtgtgttgtgtgtggagtgggggcggctgttacgtctgcgcccagctgtctgttgtactcattgtgctcatgaagtaggctactccctttcgctttatcctatcagtggtggctggtggtggggataacacatagagaagggctgaacagtgttgtatgggtgggtgtaatgtgtttctactatggtggctcttgctagagaaccaagaatttcaagagaacacaccaaagcatatctcgagcgctgcgggccctgtgtgcatctacaggggggatattcttcccagatgacccaggagcctgtatcgtgagtcatgtgtatatctgttacccttaagaagtgtcggggattatataattactctcagtgatttatgagaagcgagactgtcgtcttctcctagttcatataagttgatgattatagtgtgtcccacaagtatggctatggtattcaacactcagaatgaatggaagggtttcagggcgcagtgggttagagaaagaatttgcgacgatagtggaggggaggaatcatgtcgccatgttttgggtaataagatatcagcagggggatattacacaacgaggttgttttcatcgtgtgtctattacaccaagggggcagatgtttatcttcactgacacgtgtagtggtgtacgaaggacgaattgctcggcatacgagaacccaacttacaatcggttaaccgaaatggggcaacggtcaggcctgagctttagacagaataatgagcgaaacagcgggctgttcctctaaaaccaatggtttgaaaaaaaaagtgcgccaatcatggcagagatctatcgtttacacgccatctgcctccacgc

SEQ ID NO: 107131 - DNA, 448 bp, Homo sapiens
ccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggc

SEQ ID NO: 107132 - DNA, 712 bp, Homo sapiens
cgcggtggctcacacctgtaatcccagcactttggaaggccgaggcggtggatcacctgaggtcaggagttcgagaccagcctggccaacatggtaaaaccccgtctctactaaaaatacaaaaaagttagccgggcgtggtagcgggtacctgtaatcccagctactcagaaggctgaggcaggagaatcgcttgaacctgggaggcggaggttgcagtaagccgagattgtgccattggactccagcctgagccaaaagagcaaaactctgtcttagaaaaaaagaacttctaagacaatcagatgacacatgatgggcccaactaagatctcagtttgctttgtgccaggtggaggcaatagtaagagtgcttagtgctaactgaggtcctggcttagtactacaaggtactgtgtcgcatcactcttgacacatcgggtactgtcgtcatccacatttcacaaatgagtagaccaggactcagagaaaacttgcctaagtgcccccatttatgcaccggtagccagccttgctcaacagacttcactgccttcctggggactgttaacacgctatgaccatttgatttttttcccttttgtgctttcctaaagatgataatttggttttggccccattttgtgaaacactccagctttaacacttttagaaatgtgccacggcttcagggagaaccctttgactagaa

SEQ ID NO: 107133 - DNA, 294 bp, Homo sapiens
cttgaactctctccctgtgggattttttttcacagtgacctttcagagagtatgagctgtgaaagaagaaatccacagggatagtatggcagtgtgccaactgtaaatgtagataaaaaatctggctactatatcatcatcctcaattttaatactttgtatttacttagtagctttcagctataggactcaaaagtctacaaatagcctcaaaacaccccattgaggcaagcatagagtaatcattattttttgttaaaagaggaagtgaatggtgttatttaattgtcagtt

SEQ ID NO: 107134 - DNA, 271 bp, Homo sapiens
tttttcttttattccatcagtgaaatgtttttatagtcaaataattttgcaaaacatttttttcataattcacaaaacaaatgcgtattttaagtgttcctatagtaaaggagaatcctttaatctgatatgacaccaattttgattgactatagtataccctaaactcatttttattccaaaaaatttattgatatcattagaatagtacacatttgtgggacacttaagtttgtaattataatagctgggagaaagggttacagccaat

SEQ ID NO: 107135 - DNA, 515 bp, Homo sapiens
ccgccgccacccccgcccccacccgcaccgcggcccagggcctggcgtggatcccggcgcagatcccggcctgggtccaggcctcagacacggagaagctgctctggtgacctagacgggtcgggggatcctggcggcttaggggactggttgctggaagtcgagtttggtcagggtcccacaggctgctctcatgtggagagctttaaagtaggtaagaactggcagaagaacctgaggttgatctaccagcgtttcgtttggagtgggaccccagagactaggaaacgtaaagcaaagtcatgcatctgtcacgtatgtagtacccatatgaacagactccactcttgtctctcctgtgtcttttttggctgcttcactgagaaacatattcacaaacatgcagaaacaaagcagcaccatttagctgtagacctttatcatggggtcatatattgcttcatgtgtaaggattatgtatatgacaaagacatagaacagattgccaaagaaac

SEQ ID NO: 107136 - DNA, 516 bp, Homo sapiens
tgagacagagtctcgctctgtcggccaggctggagtgcagtggtgcgatctcggctcactgcaacctctgcctccgggctcaagcaattctcctgcctcagcctcccgagtagctgggattacacaggtgtgccaccatgcccaactaatttttgtatttttagtagagacagagtttcaccatgttggccaggctggtcttgaactcctgacctcaggtaatccaccatgcctggcctgctctgatcatctgtttcttaattctctatttcacctctaaggactgagtttgttgttgtgaaataaataaaatattgtattctaataattttttatttatcttcctcttccaataaaaatgtgattatttttaaaatgggaaatatatctctttttctattttcaatttactttccccaatagttaacagagtatttagcagatagtaggcctacaaaaatatttgacgaatgaatgaataaaagaaacatgcttgcttaaaagtaggcgtatagc

SEQ ID NO: 107137 - DNA, 338 bp, Homo sapiens
tcatagaaagccgcagatgtggtattcattccaggcttagaataccatggatttaagtgtcatttataaagtgggtacagaatatgcagtcccttctgatccccccaaaaatttactccaagaaataggctgagatagcaagactcttgttgccacagatgggtaaggatggtatttgcaggtacagtgcctccagtatcccacaagtttgtgagggaccaccagtcagccctgttaatctgtgacaccaggtagtccctcctggaattaaactttcccagaactaaccaggcaacaaggattgagacaagcaaagccccttttgcatgggagttatt

SEQ ID NO: 107138 - DNA, 443 bp, Homo sapiens
ttctgcacctgaacactttgtaatttcttatttacggttctgctcagcaaaagaccattgctaccttgaccagaacataagaaatcctgcacagaagtcagaatcaaatttcatcattaacatagaaatttaaaaaggggaaaggccagactaacattaatggagcaccctgaatgtggcagttattaagccaattatctgtatacattatcatcataaaaactttacattagccatcataaaaactcaataatgaatgtattatcaggtggggcgcggtggctcatgcctgtaatcccagccctttgggaggccgaggcgggtggatcacctgaggtcaggagagagaccagcctggccaacctggtgaaaccccgtctctactaaaaatacaaaaattagctgggcatggtggcgggcgcctgtaatcccagcttctcggg

SEQ ID NO: 107139 - DNA, 359 bp, Homo sapiens
tcttgatctccagcactcgatcccccgggttctgattggtggattgtttctgatgtgccgtcatattacccctaatatcacagggaggcttcctgcccgttttcagttaacatttcaaacaatcgaaggtaaaataacatttggtagtgggccattttgtactgaatgctgaatcgttttttctcccaagttgaaaatggttttaaggcaaagtgccttttttgagcaggtggagtcgcgcgtcctgcaggcggggcaagctcccctcaggctgggacaggttggggtacaggggcaggtacctcggtaaaggggtggagtggggcgctgcttacaacggggactgataatttgaatgg

SEQ ID NO: 107140 - DNA, 249 bp, Homo sapiens
gataaagaaaattgaagcaggcatttgtttttcttctgaagacagaagtgaagccactgtttattgaatatttttttcttttttgctatgaaaagtggagatttctctagattttcagtctcagcctttttcctccccactatgcagtacatgtacctcattcttcctaatcaaagaagcaggtcatacttaacctgaaatttcgacttaccctttgaccgctacttataaagtaggtgattattattt

SEQ ID NO: 107141 - DNA, 293 bp, Homo sapiens
gagatctcaccactgcactccagcctgggcgaacctgggcaacagagctaggctccgtctcaaaaaaaaaacgaaacaaaacaaataaaacagaattagttacagtgtctgttctgtagccttcagttgctgcctttcccaaatggggaaggaagccccttctaatgagccagcacttcttaaagacaagatccccattttcagcctttgccctgggcagacattcccaagatacaaccagctccgaagttattttttctcccctaatgatttgggaaaattcacccatgctt

SEQ ID NO: 107142 - DNA, 196 bp, Homo sapiens
tttttattttttctagacatggttcttactttgttgcccaggctggtgtccaacttctgccctcaagcaatcctcctgcctcaacctcccaaagggatgggattaaaggcacccagccttgggtttctattctaagtgagatgggaagggcacaaatgtgataagatccaaatgcacttttttttttttttttttt

SEQ ID NO: 107143 - DNA, 548 bp, Homo sapiens
aggtcagaggaagtgcagaggggaaggaggggaagcactattaactccatccttccttagcagctgactaagtcaggttggctgctgagctctgatttgggatctaagagtcaagagggcggggccaccataatgtgacagcacaggctgatttgattgccagagccaatctgtcattcatttgcttgttcacttatccatttatttatccaacaaacatgaagcgagcacagaccatatgccaagcactatgttaagggtttgggaagaagtggtatccgggaggcaaaggaagggctcagcatcactgatgttaagctcagggatgattgtcccaagcctggggactcacagcaagccccgcttgttggtagtgctctagggagtttgcatctgtttccctggagagcacatttaacccttgacttcagggaggtaagatctagacccgacgcacaactgagctggtaggggccttagatatcattgcagggcagcccctggtgttagcagtgagaccatggcctgaatggtaaagggcttgcgct

SEQ ID NO: 107144 - DNA, 138 bp, Homo sapiens
ccgcctcctagcccagcccacttggtgcaggaagggtggagggatctggggaaggccagagtgtaagaggacttaggggaggatcagcagagggtttcgggagtgatgcctgcagagaaggatctggagggcaggaag

SEQ ID NO: 107145 - DNA, 331 bp, Homo sapiens
tgattttagctactcttagtaccttatataagtggaatcatccactatttttttttctttgtgactggtttaattcacttaggagattgttgtcaaggttcatttatgttgtagtatcgcatatgtcagaaattccttcctttttaaggctgcatagtattccaccatagacatactgccaatgtggtatgtctgtaccacattttacttaactgttaattatgttttatttattgtgaataatgctgctgtgaacatgggtgtataaatatctctttggagactctgcttctgattctttttggtgtatacccagaggtggaatttgtgg

SEQ ID NO: 107146 - DNA, 237 bp, Homo sapiens
ttaatgagattgccatctaaagttcccaccatactttggaagctataatgatcatgcagatatacactttgggctgggcaatatttaagaaatgataggaaaatagaaaaatcatgattattaattgtggaattcagcttgatttgtcctaaatgttggtgtctgttgctagagtattttaaatctgtacataaataagcatgataaaataatcaaggattttttcccaggatatgg

SEQ ID NO: 107147 - DNA, 570 bp, Homo sapiens
gacatgttcatttgacttatcagttcaaagcattgtgcagccaagtaaagcacttaatcatatgttacccatcagcttatacagaaacttgagtttcaaatctttaatttaaaaataaaaatatagatttataattttatacttttcttctttagctaaagcaactattagcttgaaccgcatgaaaataccatttttattagttaaaaaaggtagaatagtggcatttaaaatggctcaatctaataataaattcttatcaaagtgttaaggtatcttaatgaatccttgctgtagtgtcaaaatcatttctgaaaaacaataattccagaatgataaaatccaaataagagagtagtatagttccacgggatatccttgctttgatcaattgcttctgtatgattacaagatattttgaatattgtcactcattcatactaaacttttttgtctgtactaaattgacatataatgtttccactccacaaaaataaactgttttggtaaataaatggctaatgaaatacatctcaaaagaaatgtgctcgttacggcacataactgtgg

SEQ ID NO: 107148 - DNA, 319 bp, Homo sapiens
gatgcaagatactatagttaacctgccatttcagaagacatgcgaaagaagaccacaaattttaaaaagtataccatcgctagtacaatatgcattgcttaatgacagggctatgttctgagacatgcgtccttaggcaattttgtcattctgcaaacatcctagagtggacttacacaaacctagatggcagagcctactagatgcgcaggccttatggtatggcctgttgctcccgggctacaaatttgtatggtgtgttactaaactgaatattgtaggcaattttaacacagtggtaagtgtttgtgtgtctgaa

SEQ ID NO: 107149 - DNA, 365 bp, Homo sapiens
tttacagcaatgaaaacgtaaatgaatctgctcacttaagggagaccaagctgtgcagaagtggtgaatgttaagccaacttgccagaaactgatttataaaccagaatgctgattcattaaatgaaatgggagatgaatctggtaagataaccggcatcaatcatttgaacagggtactccctcttaatgaataagctcattgaagaaactaaattgcagatcagaaggatttttggtacagggaattagaagagaaaaaaaaagtgttaaggggcattcccttaaactcagtttactcaatttgttcctccccattttggaagtctttcagtctacgaatctggcagcagacactggaatgat

SEQ ID NO: 107150 - DNA, 982 bp, Homo sapiens
ctgggcaacctaggaagatcctgtctgcacacacacacagccacgcacacatgcacacaagtcctgggcaaacctagcaagatcctgtctagacacacacacacacacacacacacaccacacacaccacacacacacaaccacacacacacgacgtccccactctccccaatcccgcgggccacacaacaattatactgtgtgtctctgaagagtgagacacagagaagcaacgctgatggtgctgccaccgcatatatgcgatgtcattactcatcactcaagtggcactctcatacaatatcatcttcactcctttgttgctgcaccgtggctatcacttccacgctgtcagcctaaagtgcccaaccagaggggtgacctactgtagtgggtatgtacacctcgtgctcacgatattccactcatctccttcttacgaacggcgcatagatgaattagtcgatgatatatactactttccaatatactagtggttgtactcttaactactcactcacgcggcattactccccatactcatccaagggggggcatcatttggtggtggtgcagtctcataaacacaacttgttgcggcgtgttgggagggaacaataattaactatcattatagttggagcctgttgaaaatcacttgattcattagtcggccaatcattactccttcgtcgcaggaaggcgcacccccctaaaaaacagctctgcaattaatcgctgaggcacacacacccccgaagaaatagttcgggaaaacacacgagaggaacaccaaccaccgcgacacaactcactacgtggcagggacaagaagacactggaggcggaacaccagtgacaacgaggagtgcctccccacaacaccgcaaggcaatggaacacaatgaaccaacgtatccaccacccaaccaacggcggcggggcgactccaacgtacagtgtagcgcggcatcgatgtgga

SEQ ID NO: 107151 - DNA, 190 bp, Homo sapiens
aatgagcgagcccaactgtccagactcccagcagagccttggggtttgggtagcagaggttgttggtgcctgccaactttgttacacactagcaaggtctgtgaagtaggagtggctgccagccccacaacacaccatgagaaaggagcatgagatggaaatctgtctagccaatagcaggaggctctag

SEQ ID NO: 107152 - DNA, 230 bp, Homo sapiens
agaaaataaagaaatgaagaaagatatcaggtaaatgctacatcaatgaaagctgatactcacagaattagcataaataattgcatttttacatcagtttaactcaagggacttaaactaaaggcatttcttatttatacatcccaagtagcatgacggtctcactacagccaacagactcctcttgcccaggcacctccacgtggttcaccatccctcctggctcatca

SEQ ID NO: 107153 - DNA, 356 bp, Homo sapiens
ggaggcaggggcatgcaagtgcaggggcagtccttgaattatttacagttttgatatgtaattcgtgatggactttaccacactaatttttatttttaaaagtactgtagtcgggagcagtggctcatgactgtaatctcaatacattgggaggccaaggcaggcagattgcttgagcccaagagtttgagactagcctgggcaatgtggggaaaccccatccctacaaaaaatgcaaaattagctgggcatggtggtactcacctgtagtcccgaattgcttgggcccaggaggcagaggttgcagtgtgtggggatcatgccattgcactccagcctgggtgacagagtaagac

SEQ ID NO: 107154 - DNA, 544 bp, Homo sapiens
tcttttttttaaggaaataacttttgatattatgatagaaagataaaattgaaaggaacaatcattactacacaaattacccaacattttaaatgcatttcttggaagattcggtttctgtttatttctgtaagaaaaggagaacagattttgcagatcccattagatcaaacacaagggtaacaggttagcataggaccttgtaccttataaattgttttccttcaatctcatttaaccatcatggcctctgaggagattatcatcaggtttttgaagcctaagtaaactcacactaagcctttgatggactccaaccaagttcagtaaggaaaaaaatgttcttgaaaacttgagcctttttacaagactatgtcactgcttctagaaaaatggaactgttttaagttttgaaagggaaagaatccatagccattgactaaaatatctaatattgcatcctaaatttgtccttcattttaaataatgtactgattagatgccatgtggttggttttctaaaaaattatattaaaatgtcatt

SEQ ID NO: 107155 - DNA, 383 bp, Homo sapiens
gtatccaggtctggtcagtagtttgcatgcacacgtgtgtgtgtgtgtgtatccaactctggtcagaagtcattgatcgtacccttgctgtgggccaggccttgtacaagctactgaggccacagatgtgatgaaagcagggcccctccttttacttatgatcagaaccactggttccaaacccaggggtcctaagtccaggttaggctcatatgtgggttttgtcagcctgcacgggattgttttaaaattttttgtttaggctgggtacagtggctcaggcctgtaatcccagcactttgggaggctgaggtgggtggatcacctgaggtcgggagttcgtgaccagcctggcaaacatagtgaaaccccatgtttaataa

SEQ ID NO: 107156 - DNA, 228 bp, Homo sapiens
actctccttccccctcatttcagccaaacctgccacaatgtttgctttccaacatttagagcaagaggactgccctgttttgcctggtgacataaaggactaattcagataacaaggccctggctctcggccttgccaccttctgccatcacagacccattcatctggcaatcactcctttgtcacccccgcctaccccccacggcccgtccttgcgagccatccctg

SEQ ID NO: 107157 - DNA, 338 bp, Homo sapiens
agaacagtgcctggcacagaaaaggcactgtttaagtgtggctgatatttgagagcattgacctgtgatcttctcaaagcttggggcaaacgtcggttagtgacctggcattaagaatgaggtcccactaggggagtgggagggaagaataggctttcccttgctcttgcaaggttatttctattctgtctttcttggctgctagctccccacttgccaatgcataagatctaagaaaagagatgccaagaatgaggtaagaatactaaatggaaaacaaatgaaagtgatgaaaggtggggtgtggtggcttacgtctgtaatcccagcactttggg

SEQ ID NO: 107158 - DNA, 273 bp, Homo sapiens
tcgacatcaagttcagcccgtttttattgagcatctactatgtgctggcattgaagagctcttggattcacaaaaagaaggctgccttttccagcaagtccccactgtggcctcacctgtctctgaatgacagtggaccaagcatttccacctcaccaggcaacagaacaggggacaatgactcaaaaccacaaataaaaccacatgtttaaaatactggcaaggatgtagagaaaagggaactcttacacacagttggtgggaacgtaaact

SEQ ID NO: 107159 - DNA, 533 bp, Homo sapiens
gaaaaagaaatgtagacgagagtaaacaacacagagacaagagtacagcaatgtaagctgatggtcttgctaaaggatagcgtgaaaagtgagaggagaaaaataaagaattcttcagaacattgctttccaatagaaataaaatgtgagccacatctgtcattttaaattttctagacaccacagtaaaaggggtagaaacagaaactaaagaaattattataatacagtctgtttaacacaagtctccaaaattttatcactttgacatttgatcaatataacacttattaaagggacattttctattcttatatttgtactacatctttgaaatcccatgtgtattttacacttacagcacatcttaattcgactagtcatgtctcaggtggttaacagccacatgtaactggggcctacatattagaaagcacggatctggagatagaagaaaaagatcagcctaggaactgaaaagatgtcagagaaggagaaggagaagcaggagaaaaaagcattacaacacctag

SEQ ID NO: 107160 - DNA, 397 bp, Homo sapiens
tgttatccctttttagtgatgttagtaatgtaatctcaatctctgtgtcagagttgaaacttattctctatacactacacaaagttcagctttctttataactagaccagactgtagttttatttctttgcttgttcctaccttttagaatcagattttatgaggaaacttctgaatggatgctctctctgtaatgaaccctaaattttgccagttgttgcaagggtagcagtgggcactgccttcttttaataagctggtctcccttagtccttatctgtttgggttctctgctactaatttgcttcttccattttagaaaaacactctggtggtagaaccagaatacctaattgtacttagtgatctttgaaggagtttgagtattaactgtttg

SEQ ID NO: 107161 - DNA, 276 bp, Homo sapiens
tgacaaaggtactctgcatgtcacaaaggaaatccatttaaaaattggttcattattttgactttaaattcccatcaataaagaatgatttattccacacttttattgacatgctgaatttaaaagaaaattaattgtgcatattacagtgcctgtacattgtgataactgatacagttttatcagttttagcagtgaaactttggaaattcacaagtatgaagatacaatatagagaagaaaaaatacttggaaaaccatgtgaagaaattataa

SEQ ID NO: 107162 - DNA, 372 bp, Homo sapiens
ggggtcctaattcaggtcataggatcatggcatggcccggtagcataattatccaagcaactggattctgtggcactaggatggcctctgtgcctcaaagcactagctgccacagccctattagcacaggaagctgaccaactgactctagggcagcaactgaccatccaggtactgcactcggttataactttaatggatcagagatggcatccttgattatcaaacctaagaatgactcaataccaagggctcctatgcaaaaatcctcacataaataccctaaacctggctaccttgctcccaactgatttggaaccaggaggcccccttcattgccgtgtagatggagtaggcgaggtatcctcaagc

SEQ ID NO: 107163 - DNA, 233 bp, Homo sapiens
ccctcctaccaaaaaaatagacataataaaagctaacataatatttatataaatagagggcatttggtaattatgatttatcacaatctactgagttgaaatcatttgttttggtttaactgagtaccaattcattctaacctcttttgggcttactcataggctaggcctaggattaaaataataattagtatgagagctgtgctaattattaattttaggttgcttgtctg

SEQ ID NO: 107164 - DNA, 145 bp, Homo sapiens
ggcctggcctcagagccttgggtggctgctaacagcctccacgcctgcctccctttcctcctgtttccttttcatacatacttctcatgacagccacactgaagccccacgaggcctaccagaataacctccaagaatagtgtcc

SEQ ID NO: 107165 - DNA, 372 bp, Homo sapiens
gcaagataattaagaaacttgctcaaagtcatatagcttataagtggtagatctgggatttacgccctggcaatctggctctagagctgtgccattcagtatggtagccactagccacatgttgctattgagcacttgaaatatggctagtccagattgagatgcactgtaagtgtacagtgcataccagatttttgaagacatacaggttgagcatcacaaatctgaaaattcggagtccggaatatttcagtaagcatttcctttgagttgcatgttgctgctaaaaatgttttggatttcagagtatttcgggttttagatttttggggtttgagatgctcagctggtaagtacaatgcaaatatttca

SEQ ID NO: 107166 - DNA, 524 bp, Homo sapiens
gccacaagtcttaccgtcccttaacagtattgacatttcgcttaaattatttgttaagtgaactaaaaccaatgtcatatcatctcctgaatatgatttttcatgctgtggttagtgtgatatttctcaaagtatgcaaactttttctggacaacaagagtagtgtgattgcttctttactttttgcagtgcacccaatacacacagaagcagtaacaggagttgttggaagagcagaacttttgtcatctatcttttttctagcagcttttttgtcatataccagatcaaaaggaccagacaattccataatatggactccaattgccttgacagtgtttttagtggctgttgcaacattatgtaaagaacaaggaataacagttgtaggaatttgctgtgtgtatgaagtgtttattgcccaggggtatactttgccattactatgtactactgctggacagtttctccgtggaaagggtagcattccattttctatgctgcagacactagtaaaactcatt

SEQ ID NO: 107167 - DNA, 330 bp, Homo sapiens
tggtcaggggagtggaggaggaaaggcgccgtggggatgaggaggtacagtggctggaagatgagcaagccccttaggcactattgatcgaatctatgcgtgcagggcactgtgcagtccaaccattcgtttcccagaggattggcaaaaaggatccagaagggctacctgacttatcaactgctgcaaaactcagtagcttaaaacaataaatgtttattacctcacacagtgtctgagggtcaggaatctgaatggttctggcccacgatttctaatggggctgcaaagatttcggccagggctgctgttctctgaaggtttgcctag

SEQ ID NO: 107168 - DNA, 582 bp, Homo sapiens
gagctgaaggaagcacattggtattttgtcctttcccttcttagaagatagattgtcaggcacagtggttcttgaatttgacgtatattggcatcacctggagggttagttaaagtacagatcgctggccccaccctggtctttcagattccatggggccaaggatggggctggagaatttgcatttttaacaagatctcatatgatgtgatgctgttggtttagggccacactttgggaactactggtgtgtaggaagaaagaaagaatggtgggtggagcttgtgagacggaaagataagaaatgagattataccatgctcagagtcaacattctaaaactcaaacttggagacatgactcacgtgctcaaatatctccctggcttcccactgccttaccagttgggctctgctttcgtccccagcctcatggtttacattcccctcttggactccttatctcgtgccacaagcttctcatccttcccctaatgcagtggtcctttcttcttttcctacctttgcacgtgctgctacttctaccttggcaaccccagtcctcttttctaaacctggaaaa

SEQ ID NO: 107169 - DNA, 348 bp, Homo sapiens
tcatgtcctcattgttaaaggcccatgttaaaggtcatggcctctgatcttgagcagagcaagctgctgcccctttgtggtcaggtgcgggctctgcagtgccctgaccttagaacccagcattttggtcaggatcgtgtgcttctgcttctcccacagacagtgagaaagtaggaatcatagagcacgacgtgtaggtttgaatgaatgcatgggtgtttggtgagtatcttgtttttagccagggccccagtttctgttttacagaagaagacagaggactttgtgactgctctttccattttttagatgattcactttacttccagcttcatagctgaattagtc

SEQ ID NO: 107170 - DNA, 320 bp, Homo sapiens
tttgcaacagatatgattttattattagaaaaaccagatttaaaaaaagccattatatgagttttcctagttggcaaaaattcattatatgagttatcctagttggcaaaaaaggcacttaagtgaggaaaggagatgcaaaatcatccttgactgtaaaggggtgcaggtgggatatgagcttgtctgggtatgagaatatcatgttctatgcattttttatttcctaaactgcttaaattataaatcattaatggtaattattaaaagactttgttttccctacaattagaaaaacttatttgaagacctcaaatccc

SEQ ID NO: 107171 - DNA, 707 bp, Homo sapiens
gtagaactagttacaggtcagtggaggtttaaggtatctggaataggcttgtcaaagccagacaagaaggaactttgaaaatatgaattgaaaggaagctttgaaattgttgctataaaaatacacttgattgttacatatttatatatattatatgtaattacttaattagtaatcatttttgttagcctttaaaacctgccaaggatcattttaagcacttcacataaattatccaaagtttagtgaagtaacttgcccaagatcgtaccgttaacaaagggcagagccaagatttgaggtcagggctaatacccttaagcactatgctatatactgctgatttatttatgtttatttttgttggtgactgcacagaagagttgaaccaagattagaatgatatttctgccttggctggaaaatactgatgctggggttcttggtttctgttgttgtttttaaggaagtggtaacatgggtaaatacgattgagaattcactagaatcaggacgtatacatgagatgaacttccaaatgttttctatttgattttgtctatgttaacttttgttccttctgctatatttaaaaccacaagaaaagtttactgaaacatgaagtgaattgtttcaccctggggcgtgtgcttaaaatatacccttcatgggaagagttactgaagaggttttggctgggtttattt

SEQ ID NO: 107172 - DNA, 562 bp, Homo sapiens
tagctctgtactggatactggatactggagtatcttacttttctttttttaaatgactgtttatccacatgaggtaaaagtcactattttataaacagttgataaagaaaatctaacttgaactggtttaagcagaagagggaatcttctgaaaagtcaacaaacaaataaatttgacttctgacttgacagggttcagggactcaaaagacgtctccggctccctgtgtctgatatgtcaactctgttggcttcttagctgctacacggtgagcaagatgtctgccgacagtgcacttcttacattttcctctacacaatgaaagttctggacctgactctcactggcctatattgggccacaggccagaggaatgccatttctgattggccagtctgaatcacatgttcatccctggattcagggatagagtcaactctagttaggctgagagtagcagaaagggtggttctcccagaagttcagataagcattaattaaagaaaggaaaatacatactaggtagcaaaaaagagcacatgttcactacagatgacaagc

SEQ ID NO: 107173 - DNA, 331 bp, Homo sapiens
ttccactactggtagacattgaggttgtttctgaaatatttccttttagatataacaacaccgcagtgaacatcttagtaaataaagctcaacgtgcatcccagattatttccttaaggaccaggtttcattagcagaatgacagagggggagagcccatacctgtttaaagggtttggctatctctgtgaagttgccttccacgtgggttaggctaacgtaggactccgtataccatatgtaggctgcctggttcaccgtccttgcccatggagccagcagcgagctggctgcttactgtggaagggactaaaacagcaaggaagaaggg

SEQ ID NO: 107174 - DNA, 590 bp, Homo sapiens
taaggtgagggaagacattttcaacatttctaatttttcaccattgtaaacagtctaaatatccagccctaggggaatggcaaagtcaactgttgatatcttgagtaaactaaggaatacaattgaatctatgctatgattctaatataaatctatgggcatgtaaattaggactggaaagaaacagaaaaattaaaatagtatgttaattaggtgaaattacaggtaattttatttttatattaaaatgtgtgattaaaaagaaacttaaaatttaggcttttcaaacattgactgtcacatgatattcttcagaaggctaatgttttcctttgtactcctgtattaaacttattttcagaataattggaacagctaaaaaaagcagagttactggtgtgttgtaaaggctatgttcatgatgagaaataactagccgactgaattaattctttgtctcagcctttatagaataagatgcttgggaaatttccatttccagtttttccattcaaactgacatggtttgagaacaaatacttgtaaatacattggatattttaatttcttaaatcttgtatcttagaatg

SEQ ID NO: 107175 - DNA, 410 bp, Homo sapiens
cataacccacctttcccctcctcagacccttattaggaatccagtgcctggccacctccctgaaaccctcaaccagtcatgccctggatttacactcttgcctctgcctagaacacaaatcttgtcaaagtaaacataaccactccccaaattccaactcaattcttcctctttaaagctccaagccaggaagaactttcttgagcacctgttatatcatgtatcttcctgttctccattaaatgtcaacatttgatttcaaccaagtaaagcccttgagatgaagaatctgcctgaaatttgtatactctacaaaaccataaatgatataatctcataatatacttccttgtcagaaaatatttgtaatcattccttgtaacaaaaatacacatataaccatatacatt

SEQ ID NO: 107176 - DNA, 578 bp, Homo sapiens
accctgcttccatttatgcagtatgccaggcatcggcacgattttcagtggcacacaggcggttgccaccaccagggccctaggcaaaattgcaaagaaggcagagtttgtctttggccctcccacctcccttatgcatttctctcccacctcctggcagtccccctgcccagcctcccggcaccatcatgctgccctcagattgtctaaagcccccaactttccaccactcacccaggaatgtcctttcttgaagtgcccagtgatccaaaattacctctccatttccctgctaacaaaattcctactcctaaggattccagtgaagtttaggtaatctaaatgattaactactttatgtaattcaagttaaggtatatttaactaacagacttaaatctccaatgaattttaaaaggaactaattaaaaactgtcaggaaggggagggggaagaaaccttgagggggtgaggaggtaatgttttcccaaagccccaggactctgtgccacttcagattccttcacagacaggacactaagagtggagggggtcactgccaccttgaaccccacttc

SEQ ID NO: 107177 - DNA, 636 bp, Homo sapiens
taacacatcataaaaattgtacacttccaagtaattaactttgcatatattttgtactcctgtaactgttgctcaaaatttaggaggacatttttttttaatgggtttagaatctatacagctgtcttctttctctcacacagtcactcagtaaataaatattgactgaatctcttcatcttggatatgttctcctgaatattctgggtatgggcatttttgctattaagagtgaattaaatttttgaaatgatccctagttatttggagaaaagtctaaaagaattagatgtttaactaaggtcgataatactttgttgggtaaaaactatgttaaagcactaaatctggttttcagatatagcttagaattgaatctaaaagcaattcccaaaaaggaatttcatatattttcttttggaatcattagaacaagaatatggtatcaaaaattttctgctttgcaaatgataatacccactagatacagataagttttgttctgtgtggtttttcagatcagcttcataagaacctaatttggtggtgtgatttaaatttcccaattcataacttgggatgtttatacaggtactgattaaacttggctctaatgtaattatttactttattttt

SEQ ID NO: 107178 - DNA, 677 bp, Homo sapiens
aaaatatgtaaaaatatgtgaattatcatgtaattgataccatagtgaattaatatcattttgattaaagtcaaatttgtttaaaagttttactgaattcataacagctcaaccaataatattagaaacaccactgctgtcatgtggcaatgcaagtgtttcgacattaaaaaggagtgcagggtggggcacggtggctcacacctgtaattccagcattttgggaggcccatgcaggaggatcacttggggccaggagttcaagaccagcctggacaacatagggagaccctgtctatacaaaaaataaaaacttagctgggcatactggcacatacctatagttccagctacctgggaggctgaggtgggaggatcactttagcccagaagtttgaggcaacattgagctatgatcgcaccactgaattccagcctgggcaacagagcaagaccttgtctcttaaagaaaaaaaaaaaagaaggagtgctgatgtcccaagagtctagacacctgctggactctagttgcctaactttaaagatgagaaaccccggcccaaaggagtgaaatgacccacctcacatcacccagaaagtgtttaacatagaactagatctggttcctatggccctgtaatcatattacttctctatacggctgtggacataacaaa

SEQ ID NO: 107179 - DNA, 847 bp, Homo sapiens
tacatgaagagtgacagtctcaattgtttgaaggaaagtaaaatgaacaacaaactagaatcatagcaaagaggaccctgacaatatcagaaatgatctgctccttgagatcatagcactgttcctgatttgactccctccaccattatttattctccccacacttttagtttggtagggaaaaaaccccacagtttctgtattttggaacagtgactgtgcagccaaactccctatcgctgaaaggtttctggtggaaaataactcatagatcagaatccagcctccttgaaaaagtaaaggcctaggtagtaacttgctcaacattacactgccagtttttgatagaattaactaccttaatttgttagaattgagactaacacccgaatctcttcattctaacaatgctttgtagcttctaaatgatcccacacggggtttttcaaggtcttcctcctccccaatcccttaattactcagaaacatcttttctgaactcacagcatttgataattatgtaccatgttaggaattatttttcattattgtcacacgttttaagtttagagtcatacttctggaatgaaaactatgactcatttcataagttgaaccaatcatctcatttctttatagttgcctccccaactatattaagctccttgaagataggacacatgccttacatttcttaactcttagctagtattcaacataattaatatgacgtttgatacatattagtttaattaacttcataataaaattgataagattaagtattgaatgtgctgaagaagagctctatatgaggccattgtcagtgctgacccaaaaaaaaaaa

SEQ ID NO: 107180 - DNA, 742 bp, Homo sapiens
aatctctgtcatcttgatctaataatcgttaaaaggtaaagcagtaatacagcattttttggtgctaaaatactgtgataactactatacaagtctgtgctttatcttagaatagattatccaaatttgtttggtggcaagattccagacatcaagagtcatctgaaattgtatctcaatgtatttgttactgagttcaaacagtgaaagattttaaagttaaattgcagacaagacattcccccaagtatttgagtctacatctctaaaaaaagtctgtctacataaccactctattttctcttctaacaaaattaacagtaatttcataatttcatgtcactcagatctattcagatccactcaaatcactcaaatttctctcaaatatcttttatactgatttgttaaaaccgggatctaatcaaggaccatgttatacagacattttgtcattttaattaaaaataagggccttacatttatcagtgataaattttattttgttggtagtgcctctttgggcttgtccagtaatcagcaaactttttcttaaagggccagagagtaaatattttaggcttgtggttcatttggttcttgtcacaactactcagttgtgctgcgtagtcattatggaaacacacgggcatggctgtgttccaataaaacttttgcaaaacaggcactggcccattggctgtagtgtgctgacccttgcctaacctattatgatcttggt

SEQ ID NO: 107181 - DNA, 423 bp, Homo sapiens
cccatctacttcttgtctcatgtattcatttactcaacacatatttattgaacacttgctatgtgctgggaactagtctagataccaggcctagaacaggaaacaaaataaagttcctgctctcatggagctcacattcttgatgcttgaaattagttcacagaggagtaaaatgttgcagttgaacaataagaaataagacttaaaaaggtatccatgctaaaaagaaaaaagtaaaactaaatctacttgcagatgacatgatctagtatacagataatcataaggtatctacccaaaccattaaaactcataattgagttcagcaaggttgccagatgcaagatcaaaatataaaaatccattatatttttatacactagcaatgaatgatccaaaatgaaattaagaaaacgattacat

SEQ ID NO: 107182 - DNA, 492 bp, Homo sapiens
ttttcttgcatttgagactaattcactaaattactttatattatatatttttctgtaagattatgttttctctataattttcttaagtataaaaatacaagttgtttggtaacagcctcttcttagttatctaccctttaagtatgacacatggatgtggatagttgagtcactgatgcattttattaaagtctgttttaaaagagcagataaagactgaggatgaggcatttttatgttattataagtcttaacagttctagagtataataatctagggaactaagctaaacactgtttagtttctaaaatttcaaagaacacgtcaattaccacatgccaaaatatataatctgagtatatataatgacattttagaagatttattaatgatgaataggaagaatggctctatatcttcagatgtttgcttaaaaattatagaagtccaaaaaaaaaaaacttcctaagtaaattgaggataagaccatt

SEQ ID NO: 107183 - DNA, 457 bp, Homo sapiens
aacgtatccataactcctagaagtttcccatgtccctttgtgatctcccccaactccctatcccaagtaactaccgatttgttttctgtcactatcaattggattacactgatatacctatgtacatatatcaatctggagatttacataaatacaagtacatattatgtactcttttatatctagttctttgactctatacatgttgtgagattcattcatgttgttgcatatattgagttcaatccttcttattgctgagtagtattctgttatttaaatataccaatttgtttacccattcatttattgatggacatttgggttgttttcatttttgactattctaaacaaagaagctatgagcatttaggtataaatttttctatggatataggctttattttcctttgggtaaataattaggactggaattgataatttatatggtatatat

SEQ ID NO: 107184 - DNA, 899 bp, Homo sapiens
tgccatttccaagtagttaataaattacagtttgggtttgactctgacacactatgcagccattaaaaagaagtcagtaggctgagcgtggtaggtcatgactgtagtcccagctgctcaggaggctgaggtagaaggatcgcttgggcccggaaagtcgaggctgcagtgagccattactatgccactgcattccagcctgggcagcagagtgagaccctgtctcaaaaaaagtttaatgtgctgcttcccttttctcattttacttcttttcctaagtcgtaggaaaatacctgctttggccaagacatctgaaaagaggtttatttaaggactaggagtagtagaacatgaggtttttgccgtttgtttttgttttcccttctaataaccatataattgaagttaagcaaaatttgatccatggagaaacatacaacaaagtgcaaagtgccactccctaaaaacaaggttgaacgttccttctttgctttttttgtatacatgtagtggtacattcctgtgtcttgttacacaaacaggattttaatttataaaccgcactccagcatgaccttttcatattatatctgtgatgcatttcatatcagtttctataaatatgcctcagtcttaatagctacattacaatttattgcatggatgtatttgatcatttcccttttttggacatttacataatttctggtttggaggtgcttgggggagtgccttatagtatagatccctgaagggagaggttctctaaggtgtgaatgtaacaacattttcatagatcctgtccctttgcctctggaaaagtgcagcttaccttcacccaaacagcctgaaagtgcccatgttcctgatagaaaccaccaggctcaggcagaagtggg

SEQ ID NO: 107185 - DNA, 1061 bp, Homo sapiens
gttatcctcactccaccatggactcactgttgttgtagcacttttgttttcccagtagttaaatgctacctgtgcagctgacatcactggactagatctgggaatagatgaaataatgttgaaaacaaaactttagaggtgccttctggtatcagatgctgcaaggccttgagcatcagagtgtgttaagtcccatctactgtatcaaggccagagtgtggctccatgctcttaggaagggtttcccaaccacggggccagagcccaaaaggtttccccttccctaatatgctaatgaacgaaacatgtaaatctgttttcccctgttaggctagtcttactgtgatgagaagtgtacctggctttccttttcctgggtggagacagctggggcatattcgggtggcactccctctcagtaccagaggccccactgcctgcagctggaggcatgtgaccataagctcctgcttttgctttttgggcttgcatccctcttttctgtgaactctggagaatgctggaattaaaacatttaagcattttgattaaatgagcttgagctcctctgttcttttctaggtgctcttgttctccaactctcctgcctctttctacctctgccctatacattccagctctggagacagagtctgaaactggagtctctggagggatgagaaaaccatctttaattgtaacaaatggggtgggtagacgagcttcagagtgggagcagattgcattgaggttcaactctcccacccatgcctgggagtcaagtcttggagaggagtaacactcttggtggtcagcacagctcagagtcagagacaatagccagcaggccagcaaggctggctgtgtgaggcacaggaagcagggcataggtagggagcagagctgggggttctctctctgctggaagatagcagctgccccttggcatatgggggttgcacactgcaccttgtagccagggctgctatttgctgttctgtgaaggagttggccactcattgtgacatgcaggacagtggccttctgagaacctgctgctt

SEQ ID NO: 107186 - DNA, 616 bp, Homo sapiens
atgaaacgcccatcgcctggccttcccctttcccctttcccctctcctctccattcttggagcacttcctggaaaaacaccagttggggcgccgccttcccctccaaacgttggggcctgcactctcaacctgctataaggaagttaaaccgcagctcaccgaggagtagggtgtctacggggcgggcccgtgtagaccagctgtgctcctcgggcacaaacccgccgtacatgccaggcctagaagcttttggctttgtggacgcaaaatctggttggagccgccttctccaccctgactctcccgcctctcctttttagaaggaaccgcactgagaaagggtatttctgaaggctcaatgcgtaggagaaggggtgggaagatgggtttgtggaatgggctgagggtggggagtggtcaggtgactgatttcatgtttattgtacagattcctaaaacatagttttactaagtgactccttaaattctgattaatgtgatttttttttttttttgagtgtttgggttttttagttgcaaacaggagtggaattgaaatgtgaaagtatggcaaaactgtgaaagcatttaaattaaaatgtcccttcctctgca

SEQ ID NO: 107187 - DNA, 1140 bp, Homo sapiens
atgaaacgcccatcgcctggccttcccctttcccctttcccctctcctctccattcttggagcacttcctggaaaaacaccagttggggcgccgccttcccctccaaacgttggggcctgcactctcaacctgctataaggaagttaaaccgcagctcaccgaggagtagggtgtctacggggcgggcccgtgtagaccagctgtgctcctcgggcacaaacccgccgtacatgccaggcctagaagcttttggctttgtggacgcaaaatctggttggagccgccttctccaccctgactctcccgcctctcctttttagaaggaaccgcactgagaaagggtatttctgaaggctcaatgcgtaggagaaggggtgggaagatgggtttgtggaatgggctgagggtggggagtggtcaggtgactgatttcatgtttattgtacagattcctaaaacatagttttactaagtgactccttaaattctgattaatgtgatttttttttttttttgagtgtttgggttttttagttgcaaacaggagtggaattgaaatgtgaaagtatggcaaaactgtgaaagcatttaaattaaaatgtcccttcctctgcattgaaatgtcatcaaaacgtcaaatataaatgatttgttcagttttctttttttatttgtttgtttttggttttctgtaatgacaagtccatctgtaataaaagtgagttatttttagttttctaattaagcacagaaatttcaagaaactagacaggatatccttggaatgccttaccaaaagaaacacttcatttttcacgtgttctagaagcacaacttcttttaccattaggcaaataatggtactgtaccaaacatctagaactgcgggaccatgtgtcttgattagtaattttatattgggggggcatattaggcatggctgagactaaaatgtctaaagatagatgaattgtaattttgtcaaacttatctgtacttttcaataattctctaaagagaagggacaagttctcttttctgaatgtcttcaatttgtaattccagatttgaaatatgagagcagtcatctgataggtactgattaaatatcagtagcattaaaagcatttttaagtcag

SEQ ID NO: 107188 - DNA, 542 bp, Homo sapiens
atgaaacgcccatcgcctggccttcccctttcccctttcccctctcctctccattcttggagcacttcctggaaaaacaccagttggggcgccgccttcccctccaaacgttggggcctgcactctcaacctgctataaggaagttaaaccgcagctcaccgaggagtagggtgtctacggggcgggcccgtgtagaccagctgtgctcctcgggcacaaacccgccgtacatgccaggcctagaagcttttggctttgtggacgcaaaatctggttggagccgccttctccaccctgactctcccgcctctcctttttagaaggaaccgcactgagaaagggtatttctgaaggctcaatgcgtaggagaaggggtgggaagatgggtttgtggaatgggctgagggtgggaactgatattcttcatgtgtgaaagttattcgtaccgggtctaaaactcttggctgcgaatttcttttttttcacactttaagggtgccattcccttctctggagggcagaaaagttttccgtttacaag

SEQ ID NO: 107189 - DNA, 368 bp, Homo sapiens
gtaccatgtggcccatattcagatttgtcggtggtttgaagtactagagctgagaaccactgccctcccttggttggggctgcaatctccatttattgcagtcctcattgagtccttcctttgttttatgtgagtccgtctcccaaagtgctgggattacaggcataagccactgtgcctggcctgtagattgtacgtttttataaggaggtaatagtaatagttaaattcattattgtcccaagtgaaggtaattaaaaaataaaaacttagggacggtgatgaagacagtatgctttttaatttggaaattttgtcagaatagtggcccttccagaggggtagatgaatgtatgaccatttagtcc

SEQ ID NO: 107190 - DNA, 314 bp, Homo sapiens
cagacccaaagaagcttagctaaagacgaaagatagaaattgagaggagagctgctgccccagaaacagaatttgcaattcaatacaagcaagaaaacagtgtacaaattaacattccagatgcagggcaaagttacctgctatctgtagaaccaggaacatagtgtgagagagaaaaataggttttcctcttacccctcggagtttttagctgggacagacccctgtaacaaaagacaaattaacaagagaaaaacaaataagtgttttaatgtgtgtatttcatatatacatgggacgtacccagggaatga

SEQ ID NO: 107191 - DNA, 862 bp, Homo sapiens
gaaaagagcaatcttttaaacaaatggtgcttgggcaactagatattcatatgtaaaagaataaagtaggaaccttacctaacactatatacaaaaataaattcaaaatacctgaaagatctaaaagtgcgatataaaactataaacctttttgaagaaaaagagggcaaaaacctcacagcattgtatctggcagtgattccttggatatgacaccaaaagtacagtcaacaaaagaaaaacagacaaattagacttcatgacaattaaaaacaacgtgtatcaaaggacatttgtcaacagagagaaaaagcagcctatgaaatgggagaaaatattttcaaatcatgtatctgataagatattaaaatccaaaatatatatagactcttaaaactctacatcaagaaaacctaaaaaactccttttgacttgaataaacatttctgcaaagaatatgtatgaatgatcaataagcacatgaaaagatgtttaacgtcactaattattaggggaatgcaaaccaaaatgacagtgagatactgccttacagccattagggtggctgttatcaaaacaaccagaaaaaacctgtcagtgaggatgtggagtaattagaactctttgcactgttcataggaatataaaatggtatagccactgctgaaaagaatatgacagttgcacaaaagatttaaaattgaattacaatatgatccaacagttctgcttttgaatatatatcccaaagattggaaaggaagtcttgaggaggtatttgttcacctgtgtttttagcagcagcattcgtaatagctaaagcatgaaagcagcccaggtatccattgacagaagaatggat

SEQ ID NO: 107192 - DNA, 692 bp, Homo sapiens
gaaagaaagaggtaaatccaaagttgaatctaattcacacatttagaaccatctccataaaaagtaactccacacttttggccatatttctttgaaataactgtggtttattttgttcctgttcctctcctagatactgacatctagtaatgagcagaatctaagcatttagctgtaccaattttggttcattatcatcttctttgcaggctaagtatttccattgaagtttgattagggtgtgagggtgattttgggctttgcatcataggaccagctgaatgataactgtggaggcctgcacttacctaaggaaagaaggatgaggtagacaaggcagcgtggtagccaaattagacaaagggctatcattataaaacttactgccccatcccattgttatgacaatttcagccatatccaaagcataggtttcaaacaacaggtcatgcttctttacaatgtcaggaaatcagttggttcttgtcagcattaaaaacaaaaatacaattagtgcatgacaagtaaaatagagggtaaaaaacccacagagaaaataaatttaatgaaatgtttcttcaaaaagtttttaaaaattgaaaaatcattatctggattgtctaagaaaaaatggaaaactaaaaagaaagcaggacattactaccaattttacagaaagcaaagattataaa

SEQ ID NO: 107193 - DNA, 665 bp, Homo sapiens
agggtgtggcaagagatgaacctgaaaggcagtcttggaccagatcagagaggaccttataagctacatcatgaagcttaaaatgaatccttaggtcattggacagctgtggagaaagagtttgtaagggagggaagttatatgaatacacaggaattttttaaggtggctatggtagtagtgtgaaaagagaaatgattaacagtaggcaagctcagagaaagaagccgccaaggaggctgtcaccataatccagcagaaagaagatggtggcctggactggggaagtgactgtagggatggagagaaatggatgggcttgggaaatgagaagggataggatccacagggcttaggatttgagtgaatagaaaagagagagaaaagtaaaacaagaccaacccaggtaactgggtgaggctattcccacccactaggatgaagggagaagaaccagtttgggagggaagatgacttcaagcttattcatgttgagtttgatatgtcagtggacagccaagagatgtccacttgggcagctttgaatgagaatccaggagaccagaggggaagagtgagatgaagatacggatttgagttgtatcaacatatagatggtaattagctagagaaaaggtacaaagtaagaagaaaagagcatagac

SEQ ID NO: 107194 - DNA, 320 bp, Homo sapiens
aagagagctgaggactgcatgggaactgttcatgggctgagcctagaagtaatgtacatcacttccacttccaattctattcatattctactggctgaaactctgaaggagaggctgggaaatgtagtccagctacacgttgagggagagagtgaacaggctttggtgaccacacagccatctctgctcagatacccaaggaggcaaatagaagagccagtccatgccttcaacatgcttgctccacgacctccctgagcacctgtggcctctgagtttatggtcagggtcaacagtgggggaatctcatgccaccaaat

SEQ ID NO: 107195 - DNA, 300 bp, Homo sapiens
aaccaacaaccaactatgtgactgagatcatccagccaacattctccttcaccagcaagcctatcagctgattgtatacacacgagtaagtgcaactgtgatcagccaatcctggcccttatgagcagaaccacccatctgatccacaagcttgtagacaataatatatacttacagttttaggccaccctgtttagaaataatttgttatgcagtggtagctaactaacacaatctctcttctgttctcaggatattgccccaattttaaaaaattgctcaatgaatgtggatgtaaat

SEQ ID NO: 107196 - DNA, 609 bp, Homo sapiens
accattcctgccaatccatcccagggtgactgcaccctgacagtcaggtctggccatgacctgcacacggtggctctccatcgtacttgggtcagtgactcaagtccccagcatggcagtcatgggcttgcacgactgggctgcctctctgtttctcccagcatctaaatatccccttccccatatacacacatgctgagctacaagtcatctgtggccacccactgatggtttgctaattgtgataacaaaactaagtttataatcagtttgtttttaaagactctctccactgggactggttcagggttctcctgtgcagtaatggcagggctaccccactacagctttgcatggaactgagcatgggcccagctctctgtcatgggaggagaagagactaactgcagaaaatggtgcgtatgtgtgttttaatatggactgtctccctgcaaatgccatttgaactgatggattgtcaagagcagtgctgaccccttgaaatacaatgtgaaccacaaatgcaagccccagatgtaatcataatgttctggtagccacattaaaaatgtaaaaccaaacaagtattattaattttcatcctatatt

SEQ ID NO: 107197 - DNA, 347 bp, Homo sapiens
atttgattcattcaattttttaaatttaagaataattgattagttcctgttagtcaatgttcttgcaaaaatactcaacttcttcaaaggaggagaaataatgaaaataaaaggatatggaaggtgcatcactctggagctaatgccatttgggagccttttccacacctcagcctgaatatatggatggaaggagcagttgcccaaacctacagagagccagagagagaggacggcctgagaggagttatgcagtgcctctcctgcctctgctcttcccagcctctgctcttcccagcctctgatctcccaccaggacctcatggtggtggaaaccatgcagaaag

SEQ ID NO: 107198 - DNA, 521 bp, Homo sapiens
gccggcgtggagggtgtaggtgtgtgggacattgagtcacaccagagtctaagctgtcactcttggaaagtctggggcggctcctccaccccctgcgccaggggcccccaaggccctggatgcggcaacagctctgtcttccgtcgcccagggctgatgggcacggtgaaggtcaggttggtctggaaggtgggtaggattccagaggagtggcgctctcggggggcaggtggcggtgggtgggggcccaggtctggtggcgtcagcacgcctgccttaggggtgctggcgctcaggtggcgactgcggactgcagtgcgctggatgactggtgaggcattgatggggctaaagttggcagggcggaagccgaagagtggtgagggtgagggtgatggggctggcgagaagggcgattgagtggagacgggtgagaaggagggcgtgcctgagcgcgagctgcccagcgacaccagcatcacggccgcctcacactcgtcgaactcaaagcgtgacaagtc

SEQ ID NO: 107199 - DNA, 1787 bp, Homo sapiens
  misc_feature (1510)..(1510): n is a, c, g, or t
  misc_feature (1674)..(1674): n is a, c, g, or t
  misc_feature (1677)..(1677): n is a, c, g, or t
  misc_feature (1686)..(1686): n is a, c, g, or t
  misc_feature (1699)..(1699): n is a, c, g, or t
  misc_feature (1702)..(1702): n is a, c, g, or t
  misc_feature (1710)..(1710): n is a, c, g, or t
agcctcggcctccacacactcattcctacaccatcagccacgcaacactggaacgaattggtgcagtacctgtcatggtaccagcccagagtcgggccgggtccttggtataggacatgaggaaatgttgtgttcagaaatgaataaatggaatgccctcatacaagggggagggtggggtggggagtgctgggaaagaaacacttccttataattatattagtaaaatgcacaaagaagaaggcagtgctgttacttggccactaagatgtgtaaaatggactgaaatgctccatcatgaagacttgcttccccaccaaagatgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggctttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggttactacctggcttggctggccttgcggttcaccagattaatttacaaactcccccactttattttgtgctatgtagatctggccatacttgcattagtgactgtcttgccttaaccacacttaagcaacccacaaattncttctcagatttgtttcctagattacttatgatactcatcccatgtctcaataagagtgtcttttctttctggatgtgttctcttactccctcttaccaccatactttttgctctcttctcctgcaagcgtagtcttcacagcggagtggcgttcctgacattnttntcagttaangtgaatgaatggnaanccaacagntgctgcaaacactgtataaacaacgaaggctaccatcaggaacctaaagcattgtcagccatatcaagatagataac

SEQ ID NO: 107200 - DNA, 1222 bp, Homo sapiens
tgtcacaggctttctttacagatgcggtgtaaatgaaattgttaacggggttcaaaatcagatggctaaatgtgttaatattctcatttaaacccaactacctttcttcgtctccaagcccctataatttaactctgaactataatcttttccattctatctagctcccatcctaagtcctctcctcctaacgtggaactctcctaaaatcttctccttatactagggttcgagacatgaggctgtctttttgggccttttgcgttgtcacagtcccagaccacggaacattctctcttccccaggacaggacattctctcttccccagcctccttcctgtcctggcgttgagtcttccaaatggaaaattccagccatatcaattggtgatgcacccatttcttcctgtggaacgacagtctgatggaattgcttctggagtaaatgcccagcttcttaccacttcagtgtcagcctgaatgtttggaaagttctagcacctcaaaccatttgcatctatgaaagcagaactctattttttccctttggtttagcttgtgagttctctgtgggaggaagatctgatatggccggctctctttcaaccctagttccagcagagagagagagagaatgttctgggtgacggaccctcccagcaaaggggcttgctttatttgcttctctccccaaccctccactcttagcctttgtcttttgaataatccttcctcattccacttttgtggtgggggataattagtcacaactcagtagtaagccgtgcctgctgtagagaggaagcattcagggggttggaagtgtggagaccccagtctgattgctggaatcagtgctcctcggttcagtgttttgagaccaggtctttagcttctagctgggcatatttttctgctttgtaatttaacctgtatcttttttttcccatgttcctgcctcatcagggaattgtaagatttagggggaggtgtgggaaatcttactctttgccctaaagtattcagcgatcagaattctggataccctgcaaaacacctccaacctccctgcctttgaaccctgtgttaacaatgagaagcttgtttatttgaaggctgggttctcattggcccacaggggtaggttgtaattgtgtgtctaaaaaattgccttttgcattccccaatagcatgacaactggaatagtaatttgacttaaaa

SEQ ID NO: 107201 - DNA, 244 bp, Homo sapiens
cctaatagcaattagctatacctcttcagaggggggaaatgatatgagaggggggtagggaagtgctgggtagagaagagccggtccctggctaaagctccacccctgcgcctgtgcctatggacctaggtgaggacagtcatttctgttttcgtgcccaaatgttgcatttcccaagaccaccctgacccaccacacccccatcctgtgactataaaaaccctgacacattagtgggcatgcc

SEQ ID NO: 107202 - DNA, 145 bp, Homo sapiens
tgcctctttggtcctctcttggacttcttattcttaagtctttcatgtgttcttaattcaaggaaatttatatccattatttcttcaactacttcttcctggagggaatgtaagatgggagacatccatctgttttttgaaccat

SEQ ID NO: 107203 - DNA, 291 bp, Homo sapiens
gttcctagttatctttcggtaacttttttcctaaactactctgaaaggcatagactgtctcttgaaagctcatctgttcttaacccctttccctcattccactgactgcagcatcttccacataccattccctcttagcatttatgtccatgtcatgcttttgttggtttatttgtgtattttctgcttcccaccattagatcatttgtagaattaatgaatgcctatgggttaatagatttttcgctgtatcctcttttctctgtatctctctgcccagttgcttagaaa

SEQ ID NO: 107204 - DNA, 564 bp, Homo sapiens
  misc_feature (113)..(113): n is a, c, g, or t
  misc_feature (123)..(123): n is a, c, g, or t
  misc_feature (165)..(165): n is a, c, g, or t
  misc_feature (190)..(190): n is a, c, g, or t
tgagacggagtctcgctctgtcgcccaggctggagtgcagtggcgcgatctcggcttactgcaagccccgcctcccgtgttcacgccattctcctgcctcagcctcccaaatngctgggactncaggcgcccgccaccgcgcccagctaattttttatatttttngtagagacggggtttcaccatgttngccaggatggtctcgatctcctgacctcgtgatctgcccgcctcagcctcccaaagtgctgggattacagatgtgagccactgcgcccggcctcctgaggtttttaatacaaagttctcgctgggacatttagtctgtgttagctgtagagtttttattttatttatttttatttttatattctggattcccatgaaaactgtggagtttttagaatgtaacattcaatctgcaaacacatgaatgttgtattcattaaatgtgacacaggtttgttggatgttcactgaagatgtgaatgaactcttactgtctcatactaataagacccatcattatataaattgaattggctctagttattaaaaaaaaaa

SEQ ID NO: 107205 - DNA, 321 bp, Homo sapiens
ctgcaaacactgaattagggaataccagagcattgctcctaggagaaatacagggctaggttcctatgagcctctgatgacatttttgtcaaccaatcaatacataaccttgttttgtgcatgtatgttaagatgctgtatctaatatttactgttgattcattaagactgaattcacagccaatggcactataattcatgtctgaacaaagcttatctaacacacatatttcctccctaaggaacatcacagccttcttgtgcttagaacactagacagcactagtatggggccattttaaaaagtgacctcaccaacaa

SEQ ID NO: 107206 - DNA, 436 bp, Homo sapiens
ctgcagtccctgagggacacagtccccaggcgccatctctttgaggctttgttctgtgctctgtggccttaccttgccctccctgagccaatttccctttctcaaggtggtcactgcctggtaagtttggagtaagggacggtcagaagcatttcccccacagtcaggttgtttgatgggggatgaaaagagacagcagaagttttgtgtttctgcaaaaacagaggcagtgcaggggacagtgagaggctggggtgtccaggagacctgagtctggcggtaggggcgctggtttctcatccttgaacctaattgcactgtcagtcggcccctcatgcctgagcagatgggaaggttcgtcccctgccctgcagcaagagggccctgtccaggaggcacccacagcaggggcagtgcaggtctgtggtcactcctg

SEQ ID NO: 107207 - DNA, 215 bp, Homo sapiens
attacaggtgtgagccaccaggcccagctaatttttatatttttagtagagacagcgtttcaccgtgttgcccgggctggtctctaactcctggcctcaagtgatccgcccaccttggcctcccaaagtgccgtgattacaggcatgagtcactgtgcccggccctcaagtgatctgtcttaaatatgttttattttcttcccgattttctatcc

SEQ ID NO: 107208 - DNA, 158 bp, Homo sapiens
ttttgtgtaggttgtgatggcctttgtgtatgttgtgagttgtgtttttgaggtagggtcttgctctatcacctgggctggagtgcagttgcactgtcaaggctcactgtagcctcagcctcctggactgaagcaatcctcttacctcaatcctctca

SEQ ID NO: 107209 - DNA, 584 bp, Homo sapiens
ggaggagtggcctggtgggaggtgattggaccatggaggtgaatttcccccttgctgttctcgtgatagtgagtgagttctcacgagatctcatggtttaaaagtccggcgcttcccagttctgtctctcgctcctgccgccttgtagacgtgttcgctttgcgtttgccttctgcgtgattgtaagtttcccgaggcttccccagccatgcggaactgtgagtcaattaaacctcttttctgtataaactacccagtctcaggtacttcttgataacagtgtgaaaatggactgatacagtaatgatataagctagcatgactgctgactgtgaactggaaaatggtgctaagtacgtgacatcacttgatcttttcaatactgtgagattggtactatcattaatccattttacagatgagataaccaaggccgagtaacttgctcaaagtctcacagctgttaagaagtgaaaccaatatttgaatgcaggtttctgaccatgatcgtgcgttcttagctgatatattatgatgcctgtcactctgggtgctttaacaatgaccaccaatgagagattgac

SEQ ID NO: 107210 - DNA, 681 bp, Homo sapiens
tcaaatcagctttattgagatatgatttatatagaataaaattcattaattgtatctgtttaattattttggacaaacacgtgagtcttgtaatcatcaccacttcagtcaagatgtagaacatgtctatcatgtcaaaactttccattatgtttctttacagtcagtacccttcccccactttcagctcagcccgtgacaggcaactaagttgccttctttccctaattttgtcttttctacaatttcatatcaaataaatcagaatatgcagtattctgtgtcatactacttctacttctgatatttatgcgattcatccaagtagttagaagtctcagtagttaattcctttttcttgctgaatagtatttcatatctgcttattagttaacagtttatgaacatctaagttgtttctagtctttcgcaggcatgaataaagctattatgagtgcttgtttacaagtctttgttttaatgtatgctttgttacctcgggttaaacacctgagggtgggattcatggattatataagtatatataagaaactgggctgggcgcagtagttcatgcctgtaatcccggcactttgggaggctaaggcaggcggatcgcttgagcccaggggttcaagaccaacctgggcaacatggcaaaccctgtctctactaaaaata

SEQ ID NO: 107211 - DNA, 111 bp, Homo sapiens
ccagcaagactggctcgcatgtgtaacaagggaatccagttggccaaaggtagagaaaaatcaccaaatgtggggctatgagcctaaagcagccaatgggatcacgaacaa

SEQ ID NO: 107212 - DNA, 368 bp, Homo sapiens
ggccaattgttcttaattaagcaccaatctggttgattccatgggaatttgagatgtcatcaaggtatattgctattgtcatcttccacagactgagcaccagtcaggccactgggtctgagtccctggggctggagcgggtccagtgggcaatttattaaaagttgccaggagaagaagggtgaatgcaggccacatcctgggaaacacacactgaacgtcaatgctggagaattctgagttgtacctctaagttcatggatgagcatgatataaggaagggaaggcaaaaataaaagtagaaagacaggtactgaagtattgtaaatgaacgggtccagtatttgtgaatggaacccacaacttgt

SEQ ID NO: 107213 - DNA, 503 bp, Homo sapiens
caaacttaaactaatagtacttttttaaaaaagattttgtatatggcacacaccccttactaactttctgacttctccaaagtccaggaagctgcttcctaaaataccttgttacatagttgtgccctccttaattaagcttcctagacctgggagtgtccaggaagtctgtataagtacatgtttccagtaaatacaatgattggttaagatgtttaagttttttgaaataccagggggaaaaaaagccctttgaaaacaggtgtcatgtgcacaaaaatgcacatgaagaagtaattcactttcatatttaacagtttattataatatcctttgtttctggtactattcatttaattcttcatggtagtttttggaagtttcatatttttatggtttattaatgattgtttttttaacctcagttcttgtattcactttacagtggtttattttcatttgaataaaatactgggcagctgttaatagttttacttcatagg

SEQ ID NO: 107214 - DNA, 264 bp, Homo sapiens
tatctgcacacagagactctgcatcttcacccagagtctccaaaacatgtcccttcgatgccagagaccatcagcatcccccatccccctttcccacattcctcagagagccagccactctacatcttggccgccctatgagaaagctgggactgggcctatttcccagataggcgaaggcaggcttggagcccaggtccagtgcagagcagggctgagatgacctcagcacagtgcccatgtgacaagccagccagggcccag

SEQ ID NO: 107215 - DNA, 269 bp, Homo sapiens
gttgcccaggctggagtatagtggctattcacaggcactacgagttcaagtgtactataggctgggtgtcctggcttatgcctgtaatcccagcacttgggaggccaaggcaggtggattacctgaggtcaggagttctagaccagtctggccaatatgatgaaaccccgtttctactaaaaattccaaaattagccgggcatattggtgggtgcctgtagtccgagctactggggaggctgaggcaggagaattgcttgaaactggga

SEQ ID NO: 107216 - DNA, 570 bp, Homo sapiens
  misc_feature (311)..(311): n is a, c, g, or t
gggagggtacctgtgtttgggtgaggtgcccttcaagaagggcagttcctggagagtccccagatagaggttgtcaatagttgacactttctgcagctggcgggacagcgcttggttgagggggactctgggtggcccactacagtgtctaccacaaatgcctacctgctctccaggatacattcaaatctcgccacccccaggaggccttcttagattcccatggatcagaatgggcctgggatgctctcttcccatgtccctcaggcttgcttgagctgtctcaggcatgacagctgttgtgggtttgnaaaggctctgccactagactgtgattccctggggaagcaataatcccctttggggacatcactgacttcaaaacggttaagggtaaaaggcaaaagacctgcccgtttggggacatcactgacttcaaaacagttaagggtaggccaggcgcggtggctcaagcctgtaatcccagcactttgggaagccgaggcgggcggatcacgaggtcaggagatcgagactatcctggctaacatggtgaaaccccgtctctac

SEQ ID NO: 107217 - DNA, 324 bp, Homo sapiens
aacaggtgaaattactatgggaaatttccttatggctgttacataaccagggtcctactgtcaaaaggctgcatggatggcctctgagtagcagagctgaaataaaacattttataattagtgcatgattctaacaaaggtagacgttaagaatatgcttgcgtgttaaggggaaaatgatttttttttctagtttattttgtaattcctaggttcactctaagctttaggtctaagcgaatgaaggacaaattcttaaaacataacatttgcctgtattattgctgattttatcaccagactataagcttttcttctgagaga

SEQ ID NO: 107218 - DNA, 616 bp, Homo sapiens
tcagcttcctcctgcctcaaagggttgttgctccattgaatgagatgatgcaggtaagcaggtgaagccctggaaggcggcagggggcttggaggaggcagaagaggatgagtgcccagcggcagggagcagggagggaggggactgtggccaggcctccctcacctaccttctcatctgagcttcacagggaccccccagcggtcagtttcttcaccgcccattcacagataacaaactgaggctcagagacagaatcctcttgcccaaggtcatgtggctagtggctggtgctgctgggattctaacggaagtctgtgtgactctggagttggcctggtcccaggacatcagctgaaggacacagctgcagccccaggtgccggatgcaggttcagagcattctccttgcgcagctagagggaactcctcccctgcatgggacagagtggggcagcttccagcccctctgccaggccgtggctcacccaggccctcctgggcccacttcagcagtctctggaccataaatgcttagagggcaagcagatatctgcctccaggcactccaagaagaccttgttcctccacctcctccatgggtctaggagaagaa

SEQ ID NO: 107219 - DNA, 344 bp, Homo sapiens
ccccctacacacaaggaggaagttctctttggactgggttgaggcaggcggccggacaggtggctaatgaattcagggccagcagaaaagccctggggatgagagtggaggcctgcacagggcttatgcatggaggcgggtgctggaggccgagcctgggagagagatgggcaggcgtatccaggccaggtagggcagtgggcgactcagctctttcatggccaagtgtgggtagggatggtctggggtgagtgtcaggggacctttggggtcagtagtgatggaggggtcttctcatcccactgcctggctgcccagtgggctcttttctctgctcctttctg

SEQ ID NO: 107220 - DNA, 594 bp, Homo sapiens
ccctcgcgaggtagtatcaagatgccattaatttccatagcatcttggataacaaataagaaaaatgtcaagagaggaaagcaaagcttttgacagtggcctcattaagtggaaaacatatttcctgtattaggatggggattctccaagggaggcttaagtgaggagacctcttcttcaaattataccaatgtggaaaggagttctgtttatttgaggctatagatttgtattgctctttggtttcctgtgttttggtacatttctgaggtggaagaattctgatgtctgagccctacccccagactaattaaatcagaatatctgagagtggggcttgggcattccagtttttaaaatgcttagttgtgtggaattttcgagctctaaaaacatactttgttgacatatcataaactagtaattttgcaaaaacttttttcataagttctcagatgtacatgaccctaattaataaacctcaggactcagatttcattttagtgtcataagctttcaatttgttatatttgagtttgggattcatgagtgattattgaagccaacagagagctaggataacacgttcgcgag

SEQ ID NO: 107221 - DNA, 1013 bp, Homo sapiens
cctgccatcacgcctagctaatttttgtatttttaatagagttagggtttcaccatgttggccaggctggtctcgaactcctgacctcaggtgatccgcctgcctcagtctcccaacgtgctgggattacaggcatgagccactgcacctggccagaagatcacattataacatggaaagatttcttaaaataattttttaaaattgtggtaaaatagtcataacataaagtttaccatctttaccattattaagtgtacagtgtagtggcgttaagcctattcacattgtgcggccatctccgccatctatctccagaactctcttgtcttgtaaaactgaaactctgcacccatcaaaccgtaattctccatttcttctcctccaacccttggtaactttattctgctttccctatgaatttgactactctaggtacctcatgtaagtggaatcatagaatatttgtccttttgtgactggcttatttcacttagcgtaatgtcctcaaggttcatccatgttgttgcatgtgtcagaatttccttcctttttaaggctgaataatattccattgtgtggatataacacatgatttatccatttatctatcgacggacacgtgggctgttttcatcccttgactgttgtgaataatgctgctgtgaacttgggtgcacacatatctctttgagccctttttaataatttttgtaacacagcaataacaatagctatagatacacttgtatagacatacctaccgcagctgccaactctgggggataagatgagtggagagttttactaattccgtggtttctaaatttttttattttaattttttttaccctttattatggaaaattaaaaacacaggaatagggaggccgaggcgggtggatcacttgaggccaggagttgaagaccagcctggccaacatggtgaaaccccgtctctactaaaaatacaaaagttagccaggtgtggtggtgtgcacctgtagtcccag

SEQ ID NO: 107222 - DNA, 453 bp, Homo sapiens
gaaaaccatattcattctaaaacctttcatgaagacatgtgcattgctgctaagagtattgtttcgtttttaagttgcctgttacttggacctctgcttcctatgtacttgtttcactgttggtcatttttatggtgcagttcttttagtaggtaagaaaagcaaaggaggattgcttatgcgatgactgtttacagtggtgtcagactatgccgtgttcacgaacactttaatatgttgttgtaatctgattttatcctcgtcttacaaatgaggaagttgaagccaagaaaggctgaatcacttgcctaacgtcacataactaattatattagtcaaaccagaattcagattctaaatttatctaatgggtacgagagtaaaagacttgtcatgaaaagagcttgaacttgattgcctttggaggtatttagttgtcagtaaattgcactt

SEQ ID NO: 107223 - DNA, 269 bp, Homo sapiens
actgttgtcctttccatgtgtagtgcttccttcaggagctcttgtaaggcaggcgggtggtgacaaaatctctcagcatttgcttgtctgtaaaggattttatttctccttcagttatgaagctgagatttggcttgctgagagataatggagggggcagagtggtagcctcaatgataggtgtggaagatactatagtatagcctgcctttgctggtgagtggagattaggcctggtggaactgccatcaataaaccaagtgtgatca

SEQ ID NO: 107224 - DNA, 241 bp, Homo sapiens
cagcatggtggtgcaggatatggaaggcatatttagagtcagtataaatattgatgtgtggtacttttgcaagagtgagggcccgagttaaggcaatgagtttggcttgctgagagataatggagggggcagagtggtagcctcaatgataggtgtggaagatactatagtatagcctgcctttgctggtgagtggagattaggcctggtggaactgccatcaataaaccaagtgtgatca

SEQ ID NO: 107225 - DNA, 809 bp, Homo sapiens
tgggtctgcagtaacctcaattcttgcctcctcagaagaaagaattcaactgaggagcataaagaaaaaaagagaccaaggcaagtttcagagcaggagtggaagtttattaaaaaggctttagaacagggaagaaacacttgaaagagatccaggtgggcaacttggaaaacaagtgcagtgtttaactctgaccctaggacttcataggcttgcccctttcccatgattcttcccttagggtgtgctgcccctatgtgtggtgccctccttacccttggtaggtgaacacgtgcagtgtgtttaggaattcgtacacacgtccatctgaggcttccctctgttttccagtgggagtgccccccgaaggtcatactccaccattttgttacttactgcccatgcctgggaagttgcgtctccctggcgcttgcattcagttaacactttagtgcagcaggtgtggaccatcaggaaatgggttctccctggcgccggctgccaatatcacttttagtgaggcagtgtgataattgtcaaaccatcatctgacatttctagagccctctcctgccccactcatgcctacctacctatgatattcactgtatcatcttggaagttgatctttttggtagtttccctagccattcatagacatttagtctactgggtgaactttaagatcgctttgtccaaattcaagaaaagctgttgagattctaattacattacatttataaattaattttggaagaaccgatattttaggatttcatattttcttaaattgcaacatattaaggctg

SEQ ID NO: 107226 - DNA, 750 bp, Homo sapiens
agaagtagttgtctacttagatgataaccaaaaaccacctgtgggtgaagggctaaattaggaaggctgaagttacattggatggagtttggccaacagataaaacatctcgtcgtttaataaagagcccagatcgccttgctgatatcaactatgaaggaagattggaagcagtttcaaggaaacagggagctcaattcaaagaataccggcctgaaactggttcttgggtgtttaaggtctcccatttttctaagtatggccttcaggattctgatgaagaggaggaggagcatccgtctaaaactagtacaaagaagttgaagactgctcctttgcctcctgcaagccagactacgcccttgccagatggctctttaatggcaaagctgcacctccacctcagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacagatcatgaaagcatcattgcttactgatgaagaagatgtagatatggcactggatcaacgcttcagtcgcctgccttccaaagcagatacttctcaagaaatctgttctcccagactccccatttcagcatcccactcgtcgaaaactcgttcactaggtac

SEQ ID NO: 107227 - DNA, 398 bp, Homo sapiens
tgagcaagccagggtcctcctacacaccagactcctcagaaaccagagtcgcatggggtgaggagcccagggaccgtggctggactgcagggtggacccagcttcccctctacctgctattcctctgtttactgcacataaaaatagatgcgacagaatcttactatgttgcccaggctggagtgcagtagatttttacaggtgtggggaaactgtcaacaccctcgcctctgcaggaggtatggccatgtaacgcattgggccaaatgactgggacaggcagcaaaaccagtgtgcacttttccgtgttctcttcatttgggtaaccagttcctgcctgtggaaatttaccttccaatactcaaaataaatgaatatcattttctgaaagttaaaac

SEQ ID NO: 107228 - DNA, 716 bp, Homo sapiens
gagagggagactccatctctgttccccaggctggagtgcagtggtaagatcttcgctcactgcaacctctgcctcccaggttaaagtgattctcctgcctcagcctcctgagtagccaagatcataggcaggcaccaccacgcccagctaatttttgtatttttttgtagagacggggtttcaccatgttggccagtctggtcttgaactttgacctcaaatgatccgcccacctcagcctcccaaagtgcaactgcaatagctttctaactggctcccctacagctaccctgaccaccatttcactcccttccaccctccttgaggagttatctttttaaaaaacacaaatatgggatattttactgccatatttaaaaacacgatgatctcccagattccccaacctactacatttctgacctttcatctccacatgctcctggctatcctacgcccagttcacaccctagttaattatggtgaagtccttccccttcccttcttacataaaccatcacatgcggacccattgtgctcaaatccctgctcaaccagttcccagcccacaagacaggttgcttttttctcctttactcgttcactcagtcggtcaacaaaatgtgcaacttaaaatttcctgggggcaacagaacaaaaagtaaagcaataaattaaaactttatttaagaatgtgataaatactatgaactaag

SEQ ID NO: 107229 - DNA, 180 bp, Homo sapiens
taatgacataataagtatgtctagtattatttaagtgcctattcatattttctcatcaaagctttttatgaatgattataatgcattttctataaaatgttattgctttcactgtataccagtgattcaaactttattgtcttcaacagcaatgacatgaaatcactctagttgcccatc

SEQ ID NO: 107230 - DNA, 5764 bp, Homo sapiens
  misc_feature (5595)..(5595): n is a, c, g, or t
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacaggcctgatgcatgcaggcccatcctggttccactctgagcctgggcctgaggccagcgctggtgccagccttctccccagtgagaacagtttctctgaggctggcagtcttctgtgttcctctatcggagggtgcagcatacacctaccactcagacgcttcccgggtttctccaggcccttggcctggatggggatggggtcataggtctgcacagagcaggcgtagacccggctttctgggcagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaataagcgtctgtatgaagagtgcgcgatcagttccgttacctgccctgcaccctggggagaggaccagggatgggaacccctggcagctgctgccagtcctggaggctcagcccggcgtgccactgctgctacagaaaccaggtcatttgtgcacagcccggaaggcagcggcgcgagttcccgggtgtggtcaccgctctgggtggtgcgcttgtcaatgccccttttgatgcccttgaatagcctgaagatgaaggggaccgggggagggttgcaagcgccatggcctatgcaggctgcggcctctggccattcggagggaaggccccagggagccacctgagtggagctcagaacactggattcgcgcgaaggggaggtgtctgggcgtgcggccccagccccgccaccttcctgggccctgtggtcccaccctccggactaccaaggcacagctgtgtcgcacgttccgcccggtgcctgggacgggctcagccgccagggggcgccgccgccccgagagcctcacgccccgcccccaggctcaaactcttccccctccccactctggctccgcccccggtctcctcttttgctctggccccgcccacctcccctccggcctcggccccgcccccaatcccccatagctctgcgactaagaaaccacaggctgaaggcgactgcagggtcctgccccttgcccagcctcaggactatggagggggcgagtgacgcgcaaggaacggagcaggggacaccgtgcgggctcaggagctccccagatgcccgagccgaaccgcggggtcctcaccgccaggttccagcccaggaagcgctcgcctgccccacagcctgggccttgggtcgcgttccgagctccaggacggctggtgtcccccgcggcctgcgatgacagcccagggccgctgagccggggccgcaggaaaggctggcgctggcaggcgcttccgtcggcagcactgtgtttgtgtttccacgtggaaacagcagcgcacgtgtacaactgtgcataccaaggcgtgcgtgccagtgcgcgggtctcgggatcacttcccagtgcggtgcacgaccccgcctgcagcagtgggtgtgggggcgctgctgggctcatcccgaagctcagagagcgtggggctgcccctaggctcggaatgagtctcccactgagtccgcagctcccctcctgccctggggcggggcttccctgacctgaaggcgtcgggggtgtcctggctcccagctcccaggcactcgtggggccaccgcccaggccagctggtgctaagtccgcagcctgtgcagcagcgcccggcttaggactgggagtgtgacttgaagggccgtcccgctcatccaagggacaaggaggagctcatggccacagggcctcggagggcatgaccccagcccagggaggagcaaccttcaggtggcctccaggaggcagctgggaaaagggcaaagctcaccagctctcaactttttttttaaataaactgaaattttagaatagtttttcagatttacagaaaagatgataaaccttagaaacattatatgctaagtgaaagtgagaagtgacagcctgctggcagtcctcacagccctcgctcgctcttggcgcctcctctgcctgggctcccactttggcagcacttgaggagcccttcagcccgccactgcactgtgggagcccctttcagggctggccaaggccggagccggctccctcagcttgcggggaggtgtggagggagaggcgcggtgggaaccagggctgcacgcggtgcttgcgggccagcgcgagttccgggtgggcgtgggctctgtgggccccgcactcggagccgccggctagccccgccagcctgggcagtgaggggcttagcacctggaccagcagctgctgtgctcgatttctcactgggccttagctgccttcctgcggggcagggctggggacctgcagcccgccatgcctgagcctcccccctcccctccgtgggttcctgcgcagtccgagcctccccaacgagtgttgccacctgctcagggcacccagtcccatcgaccacccaagggctgaggagtgcctttggagcagggcacgggactggcaggcagctctacctgcagcccctgtgcaggatccactgggtgaaagccagctgggctcctgagtctggtggggacttggagaacctttatgtctagctaagggattgtaaataaaccaattggcactctgtatctagctcaaggtttgtaaacacaccaatcagcaccttgtgtctagctcagggtttgtgaatgcaccaatagacactctgtatctagctactctggtggggacttggaaaacctttttgtcaacactctgtatctagttaatctggtggggacatggagaacctttgtgtctagctcagggattgtaaacgcaccaatcngcaccctgtcaaaacagaccactcggctctaccagtcagcaggatgtgggtggggccagatgagaataaaagcaggctgcccgagccagcagtgacaacccactcgggtccccttccacaccgggatgctttgtttgttcgctctttgcaataaatcttgctgctgctc

SEQ ID NO: 107231 - DNA, 1707 bp, Homo sapiens
gcagcctcagaccctgccacccccacccacagccccacacccagccccaggcacttctctctgcttctcaagaacattcccgtccttctttctgccgagcctgtcctcttcagggttagctcaggtccctcttccccgtcttgtcccctggggtccttctctccaaaggcctgatgcatgcaggcccatcctggttccactctgagcctgggcctgaggccagcgctggtgccagccttctccccagtgagaacagtttctctgaggctggcagtcttctgtgttcctctatcggagggtgcagcatacacctaccactcagacgcttcccgggtttctccaggcccttggcctggatggggatggggtcataggtctgcacagagcaggcgtagacccggctttctgggcagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtaaggcgggcgctggcctcccacagccgctcctgacccaggaggcctgggtgggggctgaatctctgtccccgggcctaggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccaggtgcctggtcagggagggagcgaagccttctggctcctggggaagagaggtggcttctgaggtcttcccatccaggtgttgtgaaatggtcgcagcagcgcaggtcctgggtgggccctgctgagctaaagccactctgctgggcgcttcaggcctggcccctccacacagacccctgtcctgggaggggagcatctgcagctgacggagggaccttctttccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaa

SEQ ID NO: 107232 - DNA, 812 bp, Homo sapiens
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggagggtgacagaaacgaggaggtcagagccgtgggccagggcgtgctacgagcgctggagagccggcagcctgagggacccagcctcagacacctcctccccgtcatggccaagaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgaacaaggtcaagagcagagaggggataccaatactgtacggtgaatctcccgacaaacttcatctgacaggcacgctagatagacgcaccgagaagcaggatacggaaaggttggccttcagagtaactgcaaagctcaatagagcaaagtaacc

SEQ ID NO: 107233 - DNA, 2876 bp, Homo sapiens
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaa

SEQ ID NO: 107234 - DNA, 2551 bp, Homo sapiens
cccggaagttgaccggggtgcggagctcctgggctgcagctcctggagtttccgaggttcgtgcgcgtctggtggcggcggcgtgatgttctcggcaggagcggagagtttgctccaccaggccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaa

SEQ ID NO: 107235 - DNA, 3104 bp, Homo sapiens
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggagggtacgcggggcccctcccaagaggctgttgggggtctgccttcccaggtccttccctgagggcccatggtgggttgggagtgtggggggcaggtgggggacacggggaggcccgagggtttgggacgctgcaggattctgttttctgagaaaagtcggccagcatcccaacaacccaggcatctgtaggattcaacctcacctccccatgccaccccacccactgcagaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaa

SEQ ID NO: 107236 - DNA, 2842 bp, Homo sapiens
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaagaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaa

SEQ ID NO: 107237 - DNA, 2053 bp, Homo sapiens
agtactatgcgggcttattggttagcgaggcctgggtggcgcctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaa

SEQ ID NO: 107238 - DNA, 3405 bp, Homo sapiens
  misc_feature (2883)..(2883): n is a, c, g, or t
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtgtgggccatcggcgagtacctgtcggtgacctacgatcggaggtgcaccgtggagcagatcaacaagttcttcgaagccctggaggctctgctattcgaggtcacccagtgccgcccctctgctgccctgcccaggtgtcccccccaggtggtcaccgtgctgatgaccacgctgacgaagctggcctcccggagccaagatctgatccccagggcctctttattgctgtcaaagatgaggaccctggctcacagtccagccaccagctccacgcacagcgaggagggcgcggaagccatccgtacccgggccacagagctgctgaccctgctgaagatgcctagcgtggcccagtttgtgctcacacccagcacggaggtgtgcagcccccgctatcaccgcgatgccaacacggccctgcccctggccctgcgcacggtcagccggctggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaaaaaaaanaaaataaaaaaaaaaaaaaaaacaaacaacaaacataaaccaccaaaaaccacccatcaacaccaccatcacataaacaggggcaccaccttataatataccgccacgggacccatatttctacgacagccaatactcttcacaaatgtttccccacctaataaactctcttttcatgaagccgaacagacaggcaccggccgttcaacacaagagctgttgatgcgctgccacacagcataccacgggaaggccaattcgcgaaggccacgcacaccacacacaggcggtgggcacaccacacttctgtgtgcgagaaccacatccccctccgccccgaccaattataaacgtcgcgcctcctgtcaatccatatacgtcaatgactcacgcagagagcgcacatacagtggcgtgcaaacaaacacagctgcactaactatgttgatgaccagacaacaaagcctgctgcccgctcccggaacgccgcgatagttatactacactcgcctcttttctacc

SEQ ID NO: 107239 - DNA, 2273 bp, Homo sapiens
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtgctctccagcggccaccgcttcacagacgaccagtggctgaacgtgcaggccttctctatgctgcgggcgtggctgctgcacagcggccccgagggcccgggcaccctggacacagatgacaggtcagagcaggagggctccactctgtcggtgatctccgccacctcctctgccggccgcctgctgccgccccgggagcggcttcgggaggtggccttcgagtactgccagcgcctcattgagcaaagtaaccgacgagccctgaggaagggggactccgacctgcagaaagcttgcctggtggaggccgtgctggtgctggacgtgctgtgccggcaggacccgtccttcctgtaccgaagtctctcctgcctgaaggccctgcacgggcgggtgcgcggggacccggcctctgtgcgggtgctgctgcccctcgcccacttcttcctgagccacggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaagttcctggcctggaacagcccacccctcacctccgagtttgtggcgctcctcccggccctggtggacgctggcacagccctggagatgctgcacgcgctgctggacctgccctgcttgacggcggtgctggacctgcagctcaggtcagcaccggctgcatccgagaggccactctgggacacctctctcagggcccccagctgcctggaggccttccgggacccgcagttccagggtcttttccaatacctgctgcgccccaaggccagtggcgccactgagaggttggcgccactccaccagctgctgcagcccatggccggctgtgcccgcgtggcccagtgtgcccaggccgtgcccacgctgctgcaggcattcttctcagcagtgacccaggtggctgacgggtccctgatcaaccagctggcgctgctgctcctgggcaggagcgactcgctctacccggccccagggtacgctgccggtgtgcacagtgtgctgagttctcagttcctggccctgtgtacgctgaaaccctccctggtggtggagctggcaagagacctgctggagttcctgggcagcgtgaatggtctctgcagcagggcgagcctcgtcaccagcgtggtaaggcgggcgctggcctcccacagccgctcctgacccaggaggcctgggtgggggctgaatctctgtccccgggcctaggtgtgggccatcggcgagtacctgtcggtgacctacgatcggaggtgcaccgtggagcagatcaacaagttcttcgaagccctggaggctgctgggtctgtttcctagtcttttgtttttggacagttgatgggcaagaagagctgcagtaaaagtaaatctcctttaa

SEQ ID NO: 107240 - DNA, 1157 bp, Homo sapiens
cccggaagttgaccggggtgcggagctcctgggctgcagctcctggagtttccgaggttcgtgcgcgtctggtggcggcggcgtgatgttctcggcaggagcggagagtttgctccaccaggccagggagatccaggacgaggagctgaagaagttctgttcccggatctgtaaactgctgcaggcggaggacttggggccggacaccctcgactccctgcagaggctcttcctcatcatctcagccacgaagtacagccggaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccagggtgacagaaacgaggaggtcagagccgtgggccagggcgtgctacgagcgctggagagccggcagcctgagggacccagcctcagacacctcctccccgtcatggccaaggtcgtggtcctcagcccgggcaccctccaggaggaccaggccaccctgctcagcaagcggctggtcgactggctgcgctacgccagcctccagcaagggctcccacactccggcggcttcttctccacgcccagggcccggcagccgggccccgtcaccgaggtggacggggcggtagccacagacttcttcacggtggagagggaggccggcctcatgccagggtgaagggacagtggccagggacttcggtgcagattaagagcctgggcagccagcttgctactgaggccaggctgataggagctcaggagggcgcgggagtcctgggagaggaggcaaggcccacggtgggcttggcaccctcacagacacgcggggctggcccccctgctcaccctctgggctttgtctccgagccttttgctcccaggcaacactgagctgagctgaggggtgccatggagcggctctgattggaggcttgaggccctgtggctgggtcgggtggaggctgctgggtctgtttcctagtcttttgtttttggacagttgatgggcaagaagagctgcagtaaaagtaaatctcctttaa

SEQ ID NO: 107241 - DNA, 390 bp, Homo sapiens
ccgacccggacccccggccgcggcacctacgccccgccccagtcgctccacgccaaagcccattggtcggcaacctgtccctcctgctcatgtgatgcggcacgtgacgcagccacgtaaggccgctgcgctcacgtgacgcggtcccggaagttgaccggggtgcggagctcctgggctgcagctcctggagtttccgaggttcgtgcgcgtctggtggcggcggcgtgatgttctcggcaggagcggagagtttgctccaccaggccaggtacgggggagctgcggccccggccctccttcctgcatctctccctaggggcacacgggggtgggtctcacagggcaggggcttgggcgccagccttgcaggaacccgactggactcgc

SEQ ID NO: 107242 - DNA, 506 bp, Homo sapiens
ggattgctgtgccagatgttggtaatttttaaacttttaaatagagaaataaacagactctttttgctgtgtccctagcccaggaaacctgaaagtctaggaaccagcaccttccaaagaatgtgccatagtgtgtgtgactcacgagctgtccgtgtccctgggcgagggagaccaagtgccgcttccccagcgtcccagcgtaggacgcctcggagcccttggtgtcctggagagcaggcctgagactcagggcccctaaccagtcacagaagcacggccagggcgaggtcaagacgtgtgccctggcgggccctggtcttgcaggggaagcggctgcagtggactcggaagccgtctaccagcacctgttcaccaggatcccggtggagcagttccacagccccatgctggcctttgaattcatccagttctgcagggacaacctccacctgttcagcgggcacctcagcaccctcagattgagcttccccaacctctttaag

SEQ ID NO: 107243 - DNA, 469 bp, Homo sapiens
accctgtctctaataaaaatacaaaaagtagtcggtcgtggtggtgcgtgcctgtaatcccagctactcaggaggctgaggcaggagaattgcttgaaccgaggaggcagaggttgcagtgagcagagatcgtgccactgcactccagcctgggcaacagagcaagactctgtctcaataaacaaataaataaataaaataaacacagctaacagcactgagtatttgctatgtgccagacacagttctaggcactttttctatagtaactcatttaattcctttgacaacctgagttaccctcacagcaggagaatgaggcacatgttgataggtaaattgtccatggtcattgtggtacagtgatgggatctgaatgcaaagattcaaaaccaaagattcaagtagggtgacgagtagggcagtttaagcaggactttcctaattttagcattgagagtcttgcatc

SEQ ID NO: 107244 - DNA, 552 bp, Homo sapiens
tttcctattcactttaatattttaatttttggttgtatggaaattattcaatgaaatatctgtctttttaaaagtgtatgcttccaatcaatgttttcctagtaggacctcttggtgattcttgtatataatcacttataaagtactaatataaccttttataaaaccaagatttttaccaatccaaacatcaaaaaaaaagccttaaaataacatttttaaaaacttaagaaacccaaaccaagacttaaaaaaaaaaacacctgtcttatttttaataattctatctaacattcctatctaaattaaaaatttttaaataattattttcaacaagggaaatataactcttcaatgatcatatatcatttcaggacaaaaacatgacaattcatttatttatttatttatttttccagcagggtttctctgtgtagccctggctgtcctggaactcactttgtagaccaggctggcctcgaactcagaaatctgcctgcctctgcctcccaagtgctgggattaaaggtgtgtgccacctctgccaggccc

SEQ ID NO: 107245 - DNA, 382 bp, Homo sapiens
catatgtttcctactgagatttgaagtgagatggggaatcgatgaggcggagagaagcaggatggcaggagctgccgagaagtcggcttgtacttcgaagggaaaaagaggaaggaaaaggactgttaataaaataacaaaggcagcaatcagaatgaaccagagccaggacagcgtaaaggctaggttcacagtgagatgaaagaacctgaaaacaagtttaaaactcaaaagaggattattctcaagttatactacagtgaaaaaacatggaaaaacacaaaaaggacaggcaataaggcacaggcatacatacaaggcaaattgtaacacaatatttacttgcaaaagagcccacagagacatgtcaatgaagtcatag

SEQ ID NO: 107246 - DNA, 404 bp, Homo sapiens
tagagacagggtttcaccatgttggccaggatggtctcgatctcttgacctcatgatcttcccgcctcggcctcccagagtgctaggattacaggtgtgatccaccatgcccagccgaatattattttttgttatacattttggttaagtgattgacctggtgagttataattattataaatttaaaaatgtcatccagtagtatttgcctatttggaattaatagccttactttctcagtgagttttgccttttataatgttaagtgctctttatatgctttgaaatgctttgtactttgaaatattatagaggtcctattagtatattttgggcatttaattggatgaagaaatgatttcattttcatggccataactcaattatgttacagaatttgtttc

SEQ ID NO: 107247 - DNA, 1722 bp, Homo sapiens
  misc_feature (2)..(3): n is a, c, g, or t
  misc_feature (558)..(558): n is a, c, g, or t
  misc_feature (609)..(609): n is a, c, g, or t
tnnttttttccctgagttctgtattatcccaactaatgatctaattttaatgataatacaatgataaattatccaagtaaatgaaggcagagaggtgacttaataattaattaattgtgtaatacataaaaatggactattcttcctcattgtgattcactttatcactccctgaagcaatacaatctttccgaagatgtaaaccatggtgccaaaccatgtcattgcccagtctagttattatctcactctcattcttcttacagctttgttggaagaaagtgtccatgttgaccagagccttcattatggccttctctcctctcctggtttctatgatactgcactttcttggatttctttctaaatctctgtatgaggccttgcccggcaataccttctcacatccaactctggaaaatactgaggctctgcgctcatgatgtggttggatctctcgctctacttctttgcccagttagctcagcaccatctatatgtctcttttgtgagggcaggtaagtggtccttaaagccactcttgccactagattgcangtttgaaattggaaattgatcatggggctttccttctgagcttacctgtgnactaaaaatatttttcaatctgagtctcaaggtagacacaactagttaattggggttgagaaagaagaaaaaactgagctcccattctagattatttttgcacagaaaattctcaaattattatctccagtcacttattcacaactcttctctccttggatgtaactctgtcttttcaaatttaaaatgaaaacatttaaacaattattttccttattaaacatgtttccctttacaaataccccacttgtgtctaaattaacatgttttttcctctcagttcccaggccaaaatccttggtattatttgttcatgtttcatccaagttatatactccaactctattctttttactcactttaatatgccttaagggttcttgatttacactacctctttcatagtcctacttctttatttggattataataagggtctctacccacagtatttctagatttctccaccccacaaattcagctaagagtgtgaaaccataagccctttgatacatctactttataaagttaaaaagattctcattttacaaagtcctccctgctttctttccctccatagaatgctgggaggcaaagcctctgccttcaccacatccagagtgacttctggtatttatttccaatttccagtcatggattaaaccagagagaacatggggacatgcaatggtgtgatttgttacctaacacagctactgatcaaagtcagtaggagaatttatgaggtactgctacccacgagccccttttcagtgcacaaactcaaactagtcttttatacacaggtgagattcttcctcttcatgaaactgttccttactgacagcccaatttcttccctaacatggctgagaactatccctcaagataaggctaaccccaggatgtactgttccacctcaactttctgttgacttcatttacatatttttattataattatgttctcaaaatataaagaattgccacagcaaatgagagtgatgtactatcaagttttgaacaagattgttaactcaccttgtcagtttcccactatcttcttggattccctgaatctcagaataaataataaaaactatttcatagttc

SEQ ID NO: 107248 - DNA, 1817 bp, Homo sapiens
aatagaccaaattaaaggatgttcaataaaatctactgcctacatgaagttaacacaaccacggatgaaaacaggaaaatcagaaattctacgataagaaaacataataaggatataagggatagaaaagcaaagtattctgttgtttctttacaaacaaaagacagagcctatcaatgaatgctcatcatatatcatttgtactattactgcaattttactgttaagttattctaaagtccactcaaaatgcttgaagcagcaagtactttaatcaataaaatctaccataagcctccattttccatgcagttgacaagcacactgatgtagaaatactacataatggaaatctgtggaacaaagttatatctgtttatatggcttatagcaggaataactgagaatgggttttccttgtgctgaagttctaaaatgttatagtcttgcatcatactgagccagaaggccagaatgcagctaaagtatacagatgacatgggagcacatttaaaagactatgcccatttgaccctattagcacaagctgaaatgatgtggggtccaatactaaataggttaatttatttatactcagcctttttgaaaatgcatctctctgaggaattacacaaggcaagataaaaagatagatctcttttgctacaggaaagatgtgtatcttaccagcctggggtcaaaaatgttacctttaggggcttgatggaaccagaaaatagcagttatattcacttatttctcatcttgttatatttggaaagatctgaaaacaatcttttctgaattacaaaggctgagaaaatgttctattgagggtaatataacccataatataacatttactcagcctttgtaattactccatcaagaacagttaatcactagagataatttataagcagagggggttgccagtggacccttttactgacagatattgtttatgggagatgcaaggagtactactagattcttactaagaagcaagcaagagaatatacttactctctttgggcttacaagaaaaacaacaacagaagactgccttttactgcccaagaggccattactggcttgcagcatgttaaaaagaaatgtctcatactaagaaaaagatttataaataagtgacatggcagaaaaatggatggttcagttcatactagctagataatttgtatagttgtcaatagctggacacttaattctatattattataacttttccatcaatgtagttcaaggttaaaaataagggagatatagggaattgtgtaaatatggtattatcttaatataaaatctaagagtcagaaacttttacaaaagaattgataaaacaaaaatcattaatcttaaaatataattataatcgaaaaaggattataagaatagagctaaaatagcaaagtaaagaataataatttaaccattattttatatggctaacatactataaaaattttctatgtagatttgaatgttttttcctttcaaaaaatgtcttgcaattgctgatgtcctcatgtcaaaacaatgccactccaaccagaagcccaccaaacacttgaagtttgctgcaagccttgctcatatctaacctcaaacagaaagcagcctacaaagaataaagaacagtcaactcaacaatggtcaccttttcattgtcatttctttgtcctgctttgctctttatcttgctaagtttcatttctacttttaacataatgtcatatctcatttggagattttttttttcactcaaactaaatcaacacagattatacttgctgcca

SEQ ID NO: 107249 - DNA, 699 bp, Homo sapiens
gtccacccctaggcacaattgatcctcccatcttagcttcctgagtagttgagaccacaagcatgtaccaccatgcctggctattttttctgtatttttagtagagatggggtctcactgtattgcttaggctggtcttgaactcctgagcttaagtgatccacccaccttggcctcccaaagggctgagattacaggtgtgagccaccgtgcccagcccctccaatgtcactttcatcagagaattccttggagctcttctgtggaaaagtcatttggatcttgctctgtcacccaggctggagtgcagtggcgcaatttcggctcactacagcctcgacctcccatgtttcaagtggattatccggcttctgcctcctgagtagctgggattacaggtgcacaccaccatgcccaggtaaagaggcacctgtcttgtaaggcaggtatttttacattgtcttcaagcaaggaggaatgctaagctttaacaaagaggaatgggcaatgtgttgggtccttcttgcgctgctctaaagaaatacctggcagggaggagggagagcatcacgaagaatagctaatggatgctgggcttaatacctaggtgataggatgatctgtgcagcaaaccaccacagcacacgtttatctatgtaacaaacctgcatatccagcgcatgtacccctgaacttaaa

SEQ ID NO: 107250 - DNA, 825 bp, Homo sapiens
tgctggtctttcaactgcttttctcagatgccttttcttcttgttccatgaacttctaaagatccccctttccgaaaataccaggctgcttcatctgtctgattctctaccacctttaaatttccatatggttgtaccttcaagtagatacatttaaaaacaagtaaacaccagaaataaaccctcatctatacggtcactttgaggcaggaaaatagggtctggaggcagggaacataaggccgattcacacctcagctatgacaggaaatatcctcaccatagggtgtatgctgagtaaatgactttgtaactttacttcatcctcttcatttacatagggcatacaccaagtaaccaatggaaactcccacaaattctgtaacagggactttgagcccctgtgctcgggccactcccacactgtggagtgtactttcattttcaataaatctcttcattccttccttgctttgttagtgcgttttgtccaattatttgttcaagatgccaaaaacctagacaccctccactggtataacaaagtgatttttgacaaagttgccaagaccattcaatagcaaaaaggcagtcttttcaagaaatgtggctggaaaacaatacccacatgcacgagagtgaagttggaccgttaccttataccatattcaaaaatggtaaatcggtcaaggcgtcaatttagaggtgaaattaatcttgggggaacaacggggaggtcctcgatatgtgtggggggattttgttttaacacaggtgccaagatattatgtcctcaattaaattgtgtcggtgttatgggagacc

SEQ ID NO: 107251 - DNA, 600 bp, Homo sapiens
cgtgaactggtgccccggcagcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107252 - DNA, 1886 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107253 - DNA, 991 bp, Homo sapiens
ctagctagtacgaggctgggttcgaatcggccgagggtagagcaggtggcgaatgctgctttcacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggttttaaaaaaaaaaaagtcgagattattggtgggaaaggagtattgaagggcagggctaggttctgccagttttttaaggggaatggggccaaggggtataaagcgtattatatgaacacggggggtgaaaaataaggatgat

SEQ ID NO: 107254 - DNA, 1757 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagccagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107255 - DNA, 2025 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggttttaaaaaaaaaaaagtcgagattattggtgggaaaggagtattgaagggcagggctaggttctgccagttttttaaggggaatggggccaaggggtataaagcgtattatatgaacacggggggtgaaaaataaggatgat

SEQ ID NO: 107256 - DNA, 1627 bp, Homo sapiens
  misc_feature (1488)..(1488): n is a, c, g, or t
  misc_feature (1539)..(1539): n is a, c, g, or t
  misc_feature (1590)..(1590): n is a, c, g, or t
  misc_feature (1595)..(1595): n is a, c, g, or t
  misc_feature (1607)..(1608): n is a, c, g, or t
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagactgtgctatttcagtgtagtgcttctcattataaatgaatctaatatggggcttcnaaagatcatcatgtatgtgcttgtggcttaatgtaggagggtattttatantttgtagttattttaatcttatctgcccatagttggtggatgactgttggnctgcntgttcctggttnnggatctgtcggtccgagct

SEQ ID NO: 107257 - DNA, 1574 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107258 - DNA, 1479 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccgtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107259 - DNA, 597 bp, Homo sapiens
tgtgggatctctagagtctggctgctggtgttgaatgcttgtgacgtggtcgatgttttccatactgtcgtgtgtggctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107260 - DNA, 1248 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagagccaagaccgcgtgggccgcggggtgctggtaggaagtggttgggagagactttgcgaaggcggctgggggtgtttcggatttccaaataaagaaaccggagtgat

SEQ ID NO: 107261 - DNA, 1152 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107262 - DNA, 1849 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107263 - DNA, 1908 bp, Homo sapiens
  misc_feature (1845)..(1845): n is a, c, g, or t
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagtttttgcangccattagatttaaaacaacgggctcgtttggggcgaataattcaaatactatttattccaca

SEQ ID NO: 107264 - DNA, 1869 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccgccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107265 - DNA, 1471 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgccacctgcgtctcactgaggccaagctgcgcgaagaactgcgtgagaaggatcggctgcttgccatggctgtcatccgcaagaagcacggaatgtgaactggtgccccggcagcctgctggactcccagaccccatccagccaggggaccgcaggccattgttgaactccctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107266 - DNA, 1304 bp, Homo sapiens
cgcggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggctttacgtgctgcgtgccaggctgctacaacaactcgcaccgggacaaggcgctgcacttctacacgtttccaaaggacgctgagttgcggcgcctctggctcaagaacgtgtcgcgtgccggcgtcagtgggtgcttctccaccttccagcccaccacaggccaccgtctctgcagcgttcacttccagggcggccgcaagacctacacggtacgcgtccccaccatcttcccgctgcgcggcgtcaatgagcgcaaagtagcgcgcagacccgctggggccgcggccgcccgccgcaggcagcagcagcaacagcagcagcagcagcaacagcagcaacagcagcagcagcagcaacagcagcagcagcagcagcagcagcagcagtcctcaccctctgcctccactgcccagactgcccagctgcagccgaacctggtatctgcttccgcggccgtgcttctcacccttcaggccactgtagacagcagtcaggctccgggatccgtacagccggcgcccatcactcccactggagaagacgtgaagcccatcgatctcacagtgcaagtggagtttgcagccgcagagggcgcagccgctgcggccgccgcgtcggagttacaggctgctaccgcagggctggaggctgccgagtgccctatgggcccccagttggtggtggtaggggaagagggcttccctgatactggctccgaccattcgtactccttgtcgtcaggcaccacggaggaggagctcctgcgcaagctgaatgagcagcgggacatcctggctctgatggaagtgaagatgaaagagatgaaaggcagcattcgcccctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttt

SEQ ID NO: 107267 - DNA, 2069 bp, Homo sapiens
tcggggcgcctgtttctccctctctgggcttgttttcctcccccgtcacctacacttcacccaatcttggaacggagccccggcagacccggaggtggtggtgggaggccggacctatcagtgacagagctgccaagcaagccccaggatgctgactccacccgcctcccactcctcttctccgcgcgggtgctgtccgtcgtccggtgctgaaaatgtcctcccgcctcagccgccatcctgtagactcccgggggcctgcgtatgggaagatttggggtctcgaaccacacgctcctagcgagcgcgtggccgcacgcacacatacacgcatactgcaaaactggggcccagaggatccgaagtctgagagattgggtggtataggtggggcaggatcctgccccgggcctgtcccatagactctcccgtagtccagcagatttgggggcagaggtgtgctgatttgcgtcctgaagctgcagcctaaactcctgagtcatcgccgggcctgtggtcttcttgaagtgaggcccctaagcctcacttgtagtcccgggggttcctttctctccacccaggttctgatcactcccaaccccgcggagacagtcttcaggggcctccctctcacagaccttcagccaccgctttctagagagcatgagcaggttctctgcgacctctctaattagctaccaggtatccagttacaccagatgaccttcctgctccccaaactcagcccacgtggtctgattgcagtgccattgcccagaggtcccctccacctgggatgcccttccccctcatatccacttgtccataagcctagttatctttaagagttagttcatctcgtgcctctcagagggacaaaggggacagagacctgacccggtcaggggtggaggtcataggttgggttctaaggccccctctgggtgcacccaatttgccctgcatgtaagttccatgaggacaggccctgttgtcattctccacttccacccttgtcttcccaggccaagcacaatacttgcatatggaagacacccaataaacatctgtgtccaagaaattcataataaatagataaaaccctgaaaaaaaaaaaaaaaaaaagaaaaaaaaaacaaaacaaaaaaacaaaaaaaaaaaaaaagaacaagaaaaaaacaagaggggagggccccgacataaaagtactcccctacggggcacccacagagcctgcaccccccccgctactattagcatagcacgtggcgaccacctatggcgagcgcagcgcatgatcaatcggcagagcctcgcacggccagcgcagcatgaaaccaaccaccataccagaaggagtagcgaccacagcataggcgcccaccccagagcaaaatgaatctcgggggaaagagaaccccaaccatcacccctgggtgcgtcgggtccactcacacaactgtgggggtacaacaacagtcaccaccacaccaagacaacagaacacaccccgacccccgccagcgagaaaaaaaaaaagaaacaaggaccaaaacagcgcgacgtcaaaagcgggcggcaacaccccaccaaggaagggttacaaaacacggccaccgggcgccctggggaacgacgctagccgtcaccaccagcgccggccctgctatgactcgcgcacaacacaacctactctaccccccccgaggggcacccagccagcaaaacaacaccatacgatgaagacagagccactcatgcgacctcaggcgaagggcccaagcggagacgcgcgcgtagagaccaacgcacggggaatgaacacgccaacgaacagtgtacccaggcgaggcggcgtgcctcgtaggactccgacgcggcggggagcgcaccgacataagaactcgatcgaacgcgggaggggaagcatggcgatggagaggatgaatgactgatcgatgacagacaagccgcccagagcagcgccacgaggtacaaccgccgccgacagtcacggacagcaccaccaggcgcagctgacgccgcgccgaccacacgaccacagcaca

SEQ ID NO: 107268 - DNA, 272 bp, Homo sapiens
ctcacagggttcaaggtctaaatggaataatagatatgaaataactcaacaagtaaatagctcagctgttggaaatcaaacaaggagaagaaaagaaaaaggacatagtgctataaaagaaaatctttataaaattcaaaaccatttaaaatatgtcgccattgatttccttattaataggttttaatacctccatctttctctaatagttttcagtttattagaaatagtatgtgaactttttagattaaaaatttccagcacagatttat

SEQ ID NO: 107269 - DNA, 338 bp, Homo sapiens
agccttgagttcagtgacttcaccttggtagcttgaaattggccatggcaggagaatttacaccacaagaaatggcaaatgccacagatcatggcgcctccctgcttccccatccccacgcccagctggtcattaaacatttaccagcacactactgactctttccttaaaagttaaccattgtgggccaggcacagtggctcatacccataatcccagcactttaggaggctgaggctggaggatggcttgatccaacagttcaagaccagcctgggcaacataacgagaccccatctttactaaagatacaaaaaattagtcaggcatggtggcat

SEQ ID NO: 107270 - DNA, 370 bp, Homo sapiens
ttttaggtatgagcatggggtagggggagatcactgctgattaggaaaaggagcggggagggagaccccaggcttcgctcttccagagggccccaaatgcaggaagaagtgcttcaaagcaaggaacgttttcttgtgctggcaacaaacgttcactgggagaaaggccgctgtaacatcaacatcaacttaaacataggggtgcacgataaaacctgaaataacacaaagaggaacaaaacgaagcaactgaaaattactggatcacatcctcacatcaaagaaaaaaatctaaaccatcactacaagttagctacaaataatactggaaacactgcaacaccaaaagctatacaatccagccaaagat

SEQ ID NO: 107271 - DNA, 568 bp, Homo sapiens
tgcccacagtcatcatcttacaatttttacctctcctcatttccataaagctgcatatgaacgttttacctccttttttcagagattttccttctctccacctatggtctaattgtgtttaagggacacaatcctttcatttccagtggggccttggttcgggatagtctgcattgcctgtatagagattgcctgcgataacagataaaggcagggccctgcagctgagatttgatgcccacgggaagagctggaaaagagaaacttctctagttctggaagctgggatgtggatctatgtgtttgaattcaacaaggccttccctgtcctcattttatgccgtctcataatttcactgaagaaggatggcaataaattcgagcaccaagaaagtgattcagagatacccccaaaggtgttgggaggggttatacaagaggcctggcagaaaagagtagggggtgagacaaaagggaagtaaaccatgaattaagaggtggtagcactagtggtcatggtgatgatagagagatagtggaccaaagtggggaaaaggatgaaagatag

SEQ ID NO: 107272 - DNA, 367 bp, Homo sapiens
tgtgcattccttaggcctctctagatctcacaccccctatttcctttctccctcaagcccttggctcaggcacctgcactccttgctctcccttgaccatgccaggcaagctcctgcctcagggccttagcatctgctactaccaaccaaatcactctcccccctcacccagaaatatacatctctctctcccactcccgctttctcagtgtgtgtgtgcatgcatgtttatccacctatcatatatacacacacatatgcatgtatatatacacacacatatattcatattacactcctaaagaagcattttagattttgttcatccagataaatattctggacaaaggaactacatatctaaata

SEQ ID NO: 107273 - DNA, 137 bp, Homo sapiens
gtgtgacagggatacagcaactattttatcaattgtttgtatttccctttaaggtaacattttaaatgaaatgtattatattttaatctatccttttcctttgtttttgttcttattatctcttctgatatataacc

SEQ ID NO: 107274 - DNA, 404 bp, Homo sapiens
aattgaatattagagaaggaacctattagagatggattgtgtctaattcacttatttggataactattctattggcgtttgttagcaaaaaaaagccacaggctggcctaactagctataattttataacccttgttttaaaagattaagtggttgttttgggcttagtataggcaggctgctctaataacataaaacgaattttgtttatcatctgaatccttggttattgattggagaatatttattctcttagatttgttattcacagaattttgccaaatattaccaaggaggtgacattcaggaatataatttcctaatatgtagcatcaccatgcttcatcttaatttcatattttataaaagaataaaacaagtgatccagtacattttggaaaatt

SEQ ID NO: 107275 - DNA, 925 bp, Homo sapiens
acaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttaggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtatgaggggtctgaacgtctcctagccaatcagaactggctgtggaccaccctagcacggccacctctcagggccactggcaggccttcctgagttagatttgtagttgcatatttagctttgcacatttgaaataaaccacggttgcagccaccctg

SEQ ID NO: 107276 - DNA, 264 bp, Homo sapiens
ctcaggtcctctgcagaagagcccctttcagaggctcccttccctcccccatcctccggtgatttagaggacgggacaggcctgggcgggaaagaaggcggccttgcagagagcttcgtgatcacatcgttccagagtggcctcagccagggtgggagcaccccctgccacctgccgtccgtccatccacctgtccatctctctgtgggaagggactgactggtcagaggttctgtgtgtacaagcaagggattttaggggctg

SEQ ID NO: 107277 - DNA, 576 bp, Homo sapiens
cttagaatagcttgtagtttcccttatagcacttgtcaaagcttcttatacatggatctgagtgattacttgactaatgtcagtttctaataggacagttaagatccaagaggactggaaccatctggttttgcccaccattttaacctctcatccccagcaccaggcctggcacacaacaggggttcaagatattttggttaaaattgctgaatacatgatgtgtttgtgagagtaagctgcttaaatgtgttttgagtggtgcaggagcaggatgtgcaccatcggcatatccagaagtaaaccgcctgaaggtttagatcatctcataatagggaagtccctcttcttgaggtttaaattaaatatggaagtaggaaagaatgtttgtatatgtgaatgcaaagtgaatcactatcacacagttttccactgtgggttaattcatgcagttgttaggctggtagtttattgaaaataggaggctcaatttaagagctgcaatgaatcaaagtggtccaacaatgaatgtacacttgggtcttggaaattaaatgcaagcatctggcaacaaaa

SEQ ID NO: 107278 - DNA, 236 bp, Homo sapiens
agtcagtgccctttggtgccggtatctgtcttcccggccaccgctagatcaggcttctgagcctgttggctgtcagggtcggactgtgccccataggcgccatggcagtccccatgcaatccaccaggtgtcaccaggcagcatacaagtaacaggcctggaaggtccccaacagcccagctggacatgctcactctggggctcttcattcagtggcacaaactccaggacccagt

SEQ ID NO: 107279 - DNA, 429 bp, Homo sapiens
atttttaaaaattgagaaggtgtgagggacatgatggacaactacaaagatgaggagcggttggtgtgatctgatgttacgagtttcaaagctgtgggtggattacagaggtaggaggcagaataatctgaaaaataaagaagcagcctgaagaaaatctatgctgcctacaagtgcaaggagaatagggggatcggagagaaaacagctgccatttgagagaatcgtgggagaagctgtgacttcaagcaggagccagatttcagctagagctcatggagaagaacatttacaaaggagaagttgagatattgcagataactgatctgaaatttcagaggagagaatgaaatggttttagaaattcagcaggaaattggggattcttagataatgaattctttcataactcttgaatttgacgagatt

SEQ ID NO: 107280 - DNA, 774 bp, Homo sapiens
atttttttcttcagaaaacagttatttttcatcaaattatgctattttaacatttaatgggtttattattaaatgaattaatatttaaatttcacaccttgaaatttctactatggtaaataccagtaaaacaaggaaacaaaagctcttcagggtgcttaatattttaaagatatgtagagggatcttagaattgagaactgttcctctaggcatattgttctttcagttccttaaatgtgccatgtttctttgctatggggatttcactcatgttctttctgcatggcttttctgccacttcaagggagcaaatgtatgaaactctcttattcttcctatgaatcccctcattttgttagagaagcattttattatcccataacttaggactgattgccccttgacttactagtcctttaaatttctcttaagtaaaaccttgcagcttaaaaaaaagttgcgttaattcctaataaccactaacatagaatatagtcttcgtgaggactgggacttaccttttattcttctgtctcccaattcttgtattgagtaagtgtgcaataagcattttttggagcatgtgtcaggccctatgctgacccccaataagacattggaaaacaaggttatgacagtttattcttgtgtttgatagtccttcagctgttaatgacagtttttatacctccccattcttttcatctgtgaattctgttttgctttgtgatttaaataattctgtttaaatgagtgctaattccaaaaaaa

SEQ ID NO: 107281 - DNA, 122 bp, Homo sapiens
gagatcatgccagtgcactccagcctgggtaacagagtgagactctgcctcaattaaaaaaaaaatgtagataatagtttagtaagaaaagtagtgaactgaaaaccaagaaatctgactct

SEQ ID NO: 107282 - DNA, 277 bp, Homo sapiens
cagtaatgtaagatattaaaaatagaaactgaatgctggctctagggaaaccccatgtgtttgcaagttttgtgtaataaactaggaactatcatctttctaaactgtaaaatagaatgttaattacacagaaaaagaaataaaattaagagaccaaaatatcagattcatgtagttgacttagtttttatattgaagactattttctggaagcagtcaaagctagaaaaaactctgaagaatataaagtacatgtttgcttgtttttccacagaaa

SEQ ID NO: 107283 - DNA, 618 bp, Homo sapiens
gaacaggaaatagggtgagtgaaacaaacgattactatgggtcaggcagaggtccaaatctttttttttttagtttccagttaaagactgaggctaatgcatgcattcagccttcagtctttaactggaaactaaaaaggaagtactggatttgcatctaaaagtttttattctgcctttcattcttaggatttatatggttttttggatatgatgtaacattttggtatgccagttgaatgatccattaagttctaactgttattgccacatatattatacagataactttctttctccaaatagaatgaaaggctaaagaacaaactgtagatggttatctctggttgatgggattagttatttttcagtttctttgtgcttttactttatttttgctttttttgggacagggtcttgatcctcacccaggcttgagcgcagcggcgcgatcatggctcactgcaacctcaacctcccagactcagttgatacccccgcgtcagcctcctgagtagctgggactataggcgcatgccaccacacctggctactttgtgtattttttgttgcccaggctggtcttgaactcctgggcttaagtgatctgcccgcctc

SEQ ID NO: 107284 - DNA, 264 bp, Homo sapiens
tcacaggttgctattttcaaatgcatgcttagatttctcttttctcttgtcgcatttcagaagttactgtactcaccgatatgtgtatatgaatagttacttcccatacagctccccatgtttacgggaaaaaaaattcttaaaacatggtagagtacttgctctgtttggccttcaataatgttgtggatccccactgctggaatataggccaccagagatgggtttggatttcagcaataaatgacccagcttcatagaagg

SEQ ID NO: 107285 - DNA, 174 bp, Homo sapiens
gtggtgatttaagaacctaggcttcttttgttttgcggtgctgccatccccaaggaccgtgaatttctctgcctccagttggcgaataggagaagaaagagtggagaaggtatacccgcttctcacccaccttggctcagaggagaccttcaccacttccactccattcctttg

SEQ ID NO: 107286 - DNA, 274 bp, Homo sapiens
atcataaggtttgtctcaagtaatttccagttaatgaaaacaagtgtcaaaaatttctgaatgattccttttcaaaccactcatatctatgtgtgtgtgggcgcacattcatgattttgcctcaagtagcatcattcacactcacttgcattgccattgctttctttgagagtgagaagttggtacttcagctggtgtattagtctgttttgcattgccaaaaagaagaacctgagtaatttataaagaaaagaggtttatttggctcctgatt

SEQ ID NO: 107287 - DNA, 5607 bp, Homo sapiens
agcagttatcactcctccacctgcttttccatcttccagtgtggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcgctgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcttcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagatgccaactaaatgtcttcggaaatgtaaagcgtcattatccaaccaattagtacgagttaaattgattataaaatctgaaataaagttgatctacctgccccagaggcctcctgtcgttgcactagcaaggaatgccaccctgcacctgctggctttctgggggcacaaggaatgaaaatgatacgcagtgttaatattgtatggcactccaacctcaagagatctctgcctccaagagcagagaagccaagacaaatccctaacacatgggaactgcaagttggatcatccctctaggaagtctacaggtgaagccaaagatgaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacatgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctccctttttttctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaacta

SEQ ID NO: 107288 - DNA, 5278 bp, Homo sapiens
agcagttatcactcctccacctgcttttccatcttccagtgtggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcgctgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcttcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacatgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctccctttttttctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaacta

SEQ ID NO: 107289 - DNA, 3628 bp, Homo sapiens
cacgcgtcgggcatcatgctcctgttattcctcattgtggtgctgctgggcctatttgcctgtgacagcacccaccgagtgccgctctgcacccagtgctgggctgatcttggtgtagggattcagctcctccatcatgagggcagcttggtcacacctgattcctttgaagccagggctgcagtaacaggcatcatgctcctgttattcttcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacatgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctccctttttttctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaacta

SEQ ID NO: 107290 - DNA, 3095 bp, Homo sapiens
gatccaggagaggacagacaggaccagagctgagaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacatgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctccctttttttctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaacta

SEQ ID NO: 107291 - DNA, 5703 bp, Homo sapiens
gcccgctgcccgccgcccggctcccggctgctcgcggccccctgctcctgcctggcgctctggccaggctcgggctccggaggacaggaccgcgcgactggccggccgatccctgggccggccgcgggagcagctatgctgtgactgtccaggaatcgtatgcacaccccttcgatcagatctattacacacgatgcacagacatcctcaactggttcaagtgcaccaggcaccgccctgtgtacggaggagtgtgtgcacggccgctgcgtttccccggacacctgccactgcgagcctggctggggagggcccgactgctccagcggctgcgacagcgaccactgggggccccactgcagcaaccggtgccagtgccagaacggcgccctgtgtaaccccatcacaggcgcctgcgtgtgcgccgccggcttccgtggatggcgctgcgaggagctctgcgcgcctggcacccacggcaagggatgccagctgccgtgccagtgccgacacggtgccagctgcgacccccgcgccggcgagtgcctctgcgcacctggctacaccggcgtctactgcgaggagctgtgccctcctgggagccatggagctcactgtgagctgcgctgcccctgtcagaatgggggcacctgccaccacatcactggcgagtgtgcctgccccccaggctggacgggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcgctgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcttcattgtggtgctgctgggcctatttgcctggcatcggcggcggcagaaagagaagggccgagacctggctccccgtgtctcctacacacctgccatgaggatgaccagcaccgactactccctctcaggtgcttgtggaatggatagacgtcagaacacatacattatggacaaaggcttcaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacatgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctccctttttttctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaacta

SEQ ID NO: 107292 - DNA, 6117 bp, Homo sapiens
agcagttatcactcctccacctgcttttccatcttccagtgtgtgacatcctttgtctcctattcctcttttctttgtgggtttatacctgtacccctttgactctcatgtcagctgggtttgagaaagaagctgagcaaagtgcacgtctccataccagcatgtttactcagcctccttccttatgtcttctcagcactttactatgtacccatgtgagagtacttactgccttgtacttagcggtttttttggctctttctgtggtagactaggaggacaggaatcaaatcgaatcacccctagtgtctcacacagcacctcgtatacaataggcagttcctaaattgtgctgaataactggatgagcaagttggcctcagtctcccatctcccatctctaagaggagggctttggagccctggtgtccagctgtctgaacttcttctgggaagttgggtggtccctggagccacagcaggtgtgccattcccaggaaagtttggcatttctggagcaccgccatgcatgtcttcccacctttcttttagggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcgctgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcttcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagatgccaactaaatgtcttcggaaatgtaaagcgtcattatccaaccaattagtacgagttaaattgattataaaatctgaaataaagttgatctacctgccccagaggcctcctgtcgttgcactagcaaggaatgccaccctgcacctgctggctttctgggggcacaaggaatgaaaatgatacgcagtgttaatattgtatggcactccaacctcaagagatctctgcctccaagagcagagaagccaagacaaatccctaacacatgggaactgcaagttggatcatccctctaggaagtctacaggtgaagccaaagatgaaagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacatgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctccctttttttctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaacta

SEQ ID NO: 107293 - DNA, 5320 bp, Homo sapiens
agcagttatcactcctccacctgcttttccatcttccagtgtggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcgctgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcttcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaaggcaggtggatgactcagctggagaacaaagtggcttcctgagattacatgaaagaatccgtgtgcagttctagtacttgttccttgaatagcagtgaaaacccttacgccacaattaaggacccacccatcctcacctgcaagcttccagaaagcagctatgtagaaatgaagtcgcctgtgcacatggggtctccgtacacagatgtgccatccttgtcgacatctaataaaaatatatatgaagttgagcccacagtcagtgtggtccaagaaggttgcggtcataactccagctatatccagaatgcatacgacctacctaggaacagccatattcctggtcattatgacctcctcccagtaagacagagccctgccaatgggccgtcccaggacaagcaatcttaagagggataagcttctctcttgcagtgtgctctactgaatattctgactctgaaagaagacagtcccttgacttgaagtaatggtacagactggctccagctgcatgttagttattacgttcacctggaactaaagaagagcgtccaggtgggactgggataattgttcaaggaattgtgttctcaaaggcaaatcctatcacccactcagccccaaatgccctggattatatgatttttaaaacattttaagatacagctactcatcaacatcagctaaatatagctgatatatatatatatatttatctgaaacgtgatattttaaaaacatgtaggtttaacaaaccttcctaggacaaaaaggagactggggagggaagaggattactttaaagcacctgaaacgtatatgtacttttggttgctgttaccatcaacatctgttttattaccgaagacaattagtacacagacatgaactgttcttaaacagaacagtcttaaaatgtctgtacatatctgtctggtccatcaaattacaacagccaagattacagaatctatatagtctaatgctgacaacttctattttaaaaaacaagactttactttcttctgccccctaagtgataggtttaaacacacagagacacacacacacgtttccaaagtgcagcagtgtctctttcagtctacaataagattcctagggcagctttatcaaattttgccaattcaaagttcaaggacattacaagttagtcctggctttgtcatatctacttagtccatccgacacctgaatcattccatgtaaaacagagctctaagatgatcctttaagcaagcagtcatagactggtcgggattaagtaaaagacggctagttggcctcctcattttatttggtcagcatcccttgactcaagagtacttgctttcaagttcttcataaatcttgagattgacgtagtatgaaacctaaaagtatacaggaaattggacaaatgtggatacagcaagtttacactgcttaaagtacattatgctttttaatggaactaaatgatcaaaaaaagaatggactgtaaccagttgctgtaacatgatgtaaaaacgttactgtaaacagcatgaggatatgaagtccttccaccttctatcttaaaactactacttactgagctagcccaatatgcattacaatgagctaatgctccagatcccagtattcagatgtgtctataccttccactatgaacacagataaactgaggctcagataagtccaaatgaaatgaaatcaactcccaagccctaaagagaaccttctcacaagaattaaaaacaaaaagggcaaacctaggaagctaacggctactcctgtaccactctattcactggtacagtccagccagtaaaaaacacttccaaaaagatacacagaagaggaactaaatgactgcgaagctggaatactgctacaggaagtatgagagttctgaaacccttgatagaaactggaagcctgccatggaacacaatactttgggcaataatcagaaaaagcaaaaaaataaataaatgagtacatctccccttcccacatcactcaaggcataagcagattttactgttagaggaaaatatgtaatacttacatgaatgttgcatgtgtgcatgggagcaactgagtagcaatagtaaatttactttccaaaaaagccttattaaaatataaatattagaaaattactttggagacccaagtaaatatttctcatacatatgtagaaagaaatataggtaagcagcttacctcagtatttcagggcagcaagtgtttgtgaagcaaggatgagcagcatgaagatgtcagatcagcaaggagaaacttcaactcaatcccaggttttctcttcttcccttatcctgcatgtacaataactgctgcctggcaaactgcaaacaagcagcatcactcaagtttgaagtttcgccgcttttgtcaactatcctctgggcaaaggtattcagcaagaggtggaatggctagacactgaatcaagagatttcagtgttactctggtcaagttagtcgccctctctgggctccctttttttctatgcataaaaaggggagaagcagagagtgggaagacagctctactaacccttcagctctagcagtccatgactttttaaggaaatgtaatacaagtcaaaccaggcaatacagaggagaagggaaaggcagagggtgtgattatggtgacaatagctgccttcccctatcgaacagttatcagtaaaagacatttcaatcttacaaagcaactgttagaaacttctgtctaacaccatcacaaataggttcatggtcagcctaaacatgtatactgtgcattttatgggtgactttgaaagatctgttcaattatttttcagaaactaaattttcaaaaaattaatatgtgtacaattaaaatgaatgaaagaaaaaccattattgtacagaggtattaatgagactatgaaacggcaatacttttttaaatcacagatttgtaatatatgttcactgtgcagagggattgtaccttgtacaaaataaaacaaatttctcaaacta

SEQ ID NO: 107294 - DNA, 2858 bp, Homo sapiens
agcagttatcactcctccacctgcttttccatcttccagtgtggagcagtgtgtgcccagccctgcccaccagggacatttggccagaactgcagccaggattgtccttgccaccatggagggcagtgtgaccacgtgactggacagtgccactgtacagctggatacatgggggacaggtgccaagaggagtgccccttcgggtccttcggcttccagtgctcacagcgctgtgactgccacaatggggggcagtgttcacccaccacgggtgcctgcgagtgtgagcctggctacaagggcccacgctgccaggagcgactgtgcccggagggcctgcatggcccaggctgcaccctgccctgcccctgtgacgctgacaacaccatcagctgccacccagtaactggagcttgtacctgccagccaggctggtctggtcaccactgcaatgaatcctgccctgttggctactatggcgatggctgccagctgccttgcacctgtcagaatggcgccgactgccacagcatcactgggggctgcacttgtgctccgggcttcatgggagaggtctgtgccgtttcctgtgcagcagggacctatggccccaactgctcgtccatctgtagctgtaacaatggtggcacctgctccccagtagatggctcctgtacctgcaaggaagggtggcagggcctggactgcaccctgccatgtcccagtgggacgtggggcctgaactgcaacgagagctgcacctgtgccaatggggcagcctgcagccccatagacggctcctgctcctgcactcctggctggctgggagacacctgtgagctgccttgcccggatggcacatttgggctgaactgcagtgaacactgtgactgcagccatgctgatggatgtgaccccgtcacaggccactgctgctgcctggccggatggacaggcatccgctgtgacagcacgtgtccacctggccgctggggccccaactgctctgtctcctgcagctgtgagaatggaggctcctgctccccagaggatgggagctgcgagtgtgcccctggcttccgaggacccttatgccagagaatctgcccccctgggttctatggccacggctgcgcccagccatgccccctctgcgtgcacagcagcaggccctgccaccacatcagcggcatctgtgagtgcctcccaggattctctggagctctctgcaaccaagtgtgtgctggaggatactttgggcaggactgtgcccagctctgctcctgtgccaacaacgggacctgcagccctatcgatggctcctgccagtgctttcctggatggattggcaaggactgctcacaggcttgcccacccgggttctggggccccgcctgcttccacgcatgcagctgccacaacggggcgagctgcagcgccgaggacggggcctgccactgcacccctggctggactggactcttctgcacacagcgctgcccagcagcattttttgggaaggactgtgggcgcgtatgccagtgtcagaatggcgccagctgtgaccacatcagtggcaagtgcacctgccgcacaggcttcaccgggcaacactgtgagcagagatgtgccccaggaacctttggctatgggtgtcagcagctatgtgagtgcatgaacaactccacctgtgaccatgtcaccggcacctgttactgcagccctggcttcaaaggaatcaggtgtgaccaagctgccctcatgatggaggagctgaatccctacaccaagatcagcccagcactgggtgcagagcggcactcggtgggtgctgtcacaggcatcatgctcctgttattcttcattgtggtgctgctgggcctatttgcctggcatcggcggcggcagaaagagaagggccgagacctggctccccgtgtctcctacacacctgccatgaggatgaccagcaccgactactccctctcagcatcaaccacaccatggtggcctgtcatggaacacctagctcgccctttctctcaacggcctaggacccagctcagtaacaagtcccttgacagagacacagcaggctggaccccctacagctatgtgaacgtgttgttagatcagtgccctggaggccaggtacccgcccgaggacttctacattgaacttagacacctcagccgccccgctgagccacactcaccaggtgcttgtggaatggatagacgtcagaacacatacattatggacaaaggcttcaaagatgccaactaaatgtcttcggaaatgtaaagcgtcattatccaaccaattagtacgagttaaattgattataaaatctgaaataaagttgatctacctgccccagaggcctcctgtcgttgcactagcaaggaatgccaccctgcacctgctggctttctgggggcacaaggaatgaaaatgatacgcagtgttaatattgtatggcactccaacctcaagagatctctgcctccaagagcagagaagccaagacaaatccctaacacatgggaactgcaagttggatcatccctctaggaagtctacaggtgaagccaaagatgaaaggtcaggtcctgccctaggtttaaatgccggaatgtgtgaaatagggggctttggaactctgtcacttgccactctgttgctcattaactgtgaccttagactggactgtgagctttccaaggctcagtttcctcatctgcaaggttgggataattttgcctgtcctattgtctaatgcctgtcctactgtctaacaaggttatcatgagtaaccaataaaatcaccaatgggaagtgttttttgcatactgta

SEQ ID NO: 107295 - DNA, 279 bp, Homo sapiens
ctcttcatttggcttggctgacaaagcattgcacccctgtcccgcctctggccacagtgatggattcaggggtggcacacaactcaatcccggaaactggaactgatgagactcagttcttggactttggtggggagaggaccattgagaaaagggcctggccaggtgcagtggctcacgcctgtaatcccagctctcagggaggcagaggcgggaggatagcttgagcccaggagttctagacctgcctgggcaatatagagagaccccgttctccac

SEQ ID NO: 107296 - DNA, 199 bp, Homo sapiens
tggtaactgttatcctcaaataatgggtgggctcaggtacactggttactaaccacttaagtttaagaaagtgcttcttgagtttgaaataaacatatgagaagaaagtaactcttgaaagattattttatagtaatttatgaaattctcaaaaagaggtaatcactaggccatgttcctaaaggctgatacgtgctaa

SEQ ID NO: 107297 - DNA, 239 bp, Homo sapiens
taaggtttcagagggggtaaagagaaaatgtacaattaacaacatttactcatgctgaccatgctttaacccaagattttcgccacacaagtggcaatgaccaaaactaactccccaaatgcaataatctctatgaagtttctccagacactcagagatgcctccaccaagccagctgactcactacatcaaggtgacaatccagtttaccaaagagatcaaaggcatccaaaatatac

SEQ ID NO: 107298 - DNA, 204 bp, Homo sapiens
ggagtttgcaggtgaggatgagacttgaataattctcccgtacctggttctcattggctgagggactgggcatggtgctttacctataatcctcacaaaccatactcaataagtattattatctttattttgaaaataaggaaactacaaatctgcgtgttctgcacatgtatctcagaacttaaagtataatttaaaaaattt

SEQ ID NO: 107299 - DNA, 503 bp, Homo sapiens
cagcccccttgtctgttcttaactgaatggtaacttcctgttgcatggactccctgtgaagtcacacagactggtgacttaaaaggagcaggaacctctaatgaacttttaaaaggactcaacttgaaaggatttaaaattatacccaatttttgaaaaccattaactgtttaaaccattatactttgtttgctctgaacaatactataatgtggttacaatactaaccactacttttactttttttttaccaaacaacatttacctaagtgggatgaatacaaaagaataccacaaaacagcataacgaagaaaactggaaacaatttacatgctcatggaggttacttcacatcttcactgctttggaaataaccatgagaatagctttgtatctgtgttgaggtaggtgctttcgatctctggcattattaacaatttcagattaagtccactgccaatcattattcttctaacacaacaaaacttctgttactctaata

SEQ ID NO: 107300 - DNA, 855 bp, Homo sapiens
cagtagaatatgagaaaaagatttaagcactttacagaaaaggaaacacaaatgtaaacatatggaaatgaggtttaatctcattcatcattagtgatatgtgaattaaaatcataggtatatttcatacctaaccagattggtaaaaattaaaaattttgcaaataagagttggttggaaagtttatcaccgactcttaagcactcctagggtaatgtaaatgagtataatcactttggaaaacagtttggcattatctagtaaatttgataggatgacttaacttttgacccagcaattccatttctaatgatatacttgatagaaatgtgtgcccaggtacacccagaaatatatgcaagaatgttcatagcagtgttattcgagatattcaaacatcagagacaaccctaataaattgtggtatattcatacaatggaatactacaaaacaataaaaataaaggaatcacaaacatgtagtagtctagatggatctccaagaagaaaaatctgtcttatggtaggaagttattgttgaacctgaatctcctgtgatgcagtataaatgtatttcctctggttctctcctcagtggcagttaagtattaggaaagattatgtgaggattggtgtcaaccattctcagtcttttgtactaaagaaattttctggccggcgtgggtctcacgcctgtagtctcagcaaactgggaggccgaggtgggtggatcacgaggacgggctgagacagaagaatggcgtgaaccccagaggtggagcttgcagtgagccaagatcgcgccaaccgcactccggcctgggtgacagatgagactccgtctcaaaaaaaaa

SEQ ID NO: 107301 - DNA, 593 bp, Homo sapiens
agcgttatcggaagaacaagaggacagcaagatggtggatctgtttgtgggccagatgaaaagttatctcaagtgccaggcctgtgggtaccactctatgaccttcaaggttttttttttgtgacctctccctgaccatccccaagaaaggatttgctgggggcaaggtgtctctgcgggattgtttaagccttttcaccaaggaagaagagctagagttagagaatgcctcagtgtgtgacccacatgggcagaaaacacatggtgccaaaagttgacagtacaaagattcccttgaatcttcatgctccatctgaatcaattttctgcctcctgaggctccatcaagaaaagttctgtaggtgtagacttcccactgcagtgactgagcctaggggacttggccagtgacaaagtcggaagtcctgtctaccagctgtgtgccctttggaaccactcaggcagcatccactgtggccactacacaaccctgtgccagtgccagactggttggcacgtttacaatgactcttgtgtctcccctgtaagtgaaaaccaggtggcatccagtgaagcctactgttctaccaact

SEQ ID NO: 107302 - DNA, 432 bp, Homo sapiens
tggcaacaaattctctcagttttctttcatctgaaaatgtcttgattttcccttgatatctgaagaatatttacattagacatagacttgtaggtttatagttcttttctttcagcacttgaaaattgttctgccacttccagccaagaggggtggctcacgcctgtaagcccagcactttgggaagccaaggcgggcagatcacttgaggtcaggagtttgagaccagcctggctaacatggcgaaaccccgcctctactaaaaatacaaaaattagccggcatggtggtgcacatctgtaatcccagccatttgggaagctgaggcaggagaatcacttgaacccgtaggcggagattacagtgagctgagatcgcaccactgtactccagtctgagcaacagaacgagactccttgtcaaaaaaaaaaa

SEQ ID NO: 107303 - DNA, 487 bp, Homo sapiens
tcctacaccacctgcctgcggggcgggagcgtggggaggagggtgagcacgcctatgatacgctgagtctggagagctctgacagcatggagaccagcatctccaccgggggcaactcggccagcctactttggtcttttcttggactgaccccaaatttaggacatctcccttctttaactcttcctttcccatgatttgttcctaaagatggtggtttaaggccgccttcttcaggaagccctcctgggattaacccagcccatttttcccatctctcatccttcccccttacttactatcttttcatttccttttagcacatgattgttgagccagatatattcacaaataacaataataaaggcagatggtgatacagaagaatgtgagcacagaggaaggagcaaagaaatcggcaatcaaggaaggctttggagaggagatagcatttggtctagtcttagatgataagtaagctcttgat

SEQ ID NO: 107304 - DNA, 373 bp, Homo sapiens
atcatactggtagcactattacttctaaattagaatatcgtagcagtctcctgagtttcctgtgcctctttcagtccagtagttctcaaccatgggtgattctgctttgtgggcaatctttggaggcatttttggttgtcacaactgggcaaagggtatgtatgctactggcatctggtggtagagcccaggcctgctgaaaacatcctacagtgtactaaacaggcctgcactaagaaccgtctagcccaaaaagtcaacagcccagaggttgagaaatccttcttaagtctattctcaacacaggagtcctgagtgattctatgatttattttatttaaaaaactttttgtagagacagggtcttactatg

SEQ ID NO: 107305 - DNA, 575 bp, Homo sapiens
tccaagtctttgctattgtgaataatgccgcaataaacatacttgtgcatgtgtctttatagcagcatgatttataatcctttgggtatatacccagtaatgggatggctgggtcaaatggtatttctaattctagatccctgaggaatcgccacactgacttccacaaaggttgaactagtttacagtcccaccaacagtgtaaaagtgttcctatttctccacatcctctctagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttctttttttcttgtaaatttgtttgctcactcctttcttaaagcaacagccgatcattcgtggaatatttggaatctcattattcttttaatggatagttctttctctgtcagtctcttaaaaagacagtgtcttaaaaaaaaaa

SEQ ID NO: 107306 - DNA, 673 bp, Homo sapiens
caattcccaattttaaaagcaaagatttgaaagtattagtttggggacttctaacccacaagaatttagattttgtttaactgcagaaaaaaaccctcaagaacagctacaatattgtactatagtttttcttttgaagcataattttctctctccaatccccatttttattaaaaacaaatcatgataggactgatttgtttacaaaataaactttagccttactgtgcttggcctgattatttgcataaagtgcagcaagaataattatttttcacttaggctttttaagttggttttgatagaactctgttccatgaagaatctcagataagactttttaaaagctgagcccagctgtggatttgtactctcaaatacctatgagttgggcaaatttctctcctcttgaggtcccaagataacttggggttcctgggcctgttagcaagtgacattctttacttaccacgggttgtcaggaagcttgtacagagactctgtgtggacaaggtatgaggccagattccccaacaggctttaattggctctataagtcaactttgattctttaaaggaagcatgatttctccagctgtgtcctgttacaaaagaaaacagattcttattgcactaaagcaatgaactatactgccataaattgagaatattc

SEQ ID NO: 107307 - DNA, 1179 bp, Homo sapiens
agggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaaaaaaaaaaaaaaaaaaaaaaaaaaaaaaaaaaaaaaaaaaaaaaaaaggggggggggggtttaaaaaatattccttcggaggggggaccaaattttacgtgtacaaccgttttttttgaacaagggggcctaaaaaggagaggcgtaattaaaagcaaggaagcggggcgggtgttaaacagttgctgcctggggaaaatttgttctcgggttttggggagaggaacctttcttctcgggtgtggactaatttggcacaatacccagaatatataggttcggggatttaacattcggtgttaggggaacccggtctatgtgggggaaatcggtcgttgttagtc

SEQ ID NO: 107308 - DNA, 693 bp, Homo sapiens
gaacttcggctaggtacgaggctgggtgtcggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacatttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 107309 - DNA, 445 bp, Homo sapiens
cacatccagcacgccccctcgcgcaagtaatcccaaaaccccacacccgttatcacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 107310 - DNA, 374 bp, Homo sapiens
  misc_feature (44)..(44): n is a, c, g, or t
  misc_feature (48)..(48): n is a, c, g, or t
tctttttatatttaagataatcattattgcttaatcttactcantacnttttcttggtaactccacgaacacgtcctgcgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 107311 - DNA, 837 bp, Homo sapiens
tcgcccaacaattcccacacaggtcactaacacagaatgcaaatacttataacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggaccaccggattccgcctgagcctggggatcttggccttcgccaccctcctaagagacctgggaacatgaaaccacctccctggctgagtacccttcatctactcttcgcctacctcacgagatgcaattctcaccttacctctcccctatttacgcatgacataccgatcccagcttgagtgccccacgaaccgcgacgggttagtactcatcggcgtcacagtccagaatataaaaaacgagatgggcccgccgcgatccccccataaatccacggtaaggcttctcgataacagcagacccaatgttactccaatcttccctatcactccactatattaagaatgtcagtacagtcgtcatcccatcactccccatactcaactttctgtctctcaaacctgcacccatgtacccacctttcacagcatagccatgcctcactcaccgcccccccaagtctaacaatccccgcctcgaacacgaaatctacgctgagaggagggcgtcaccgtatataatatcaacaattgttattcattatccatacgtcccaccgccactcactaaaccaccgctccacctctcaaactttaacaccgattctacctcccaatacggagaatcgaccg

SEQ ID NO: 107312 - DNA, 1143 bp, Homo sapiens
agggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaaaaaaaaaaaacaaaggacaagaagaacaaaaaagagcgggaaaaaacaagaggacaacaacaagaacatgtcgcggggcgcatgaggcccgcggaaacgacttcacaaaaactcagagataggcagcagcaccacaacaaaagagagaacaaaacagggaaagaagtactcccaagaaaactggggcaacaaatagggaggagcacaaccagcaagagaacaccgcgcgggaacccgggtgatagaaaaccacaggggggacagggcaaacgggcctcaacaaggagccacggagacataaaaagccg

SEQ ID NO: 107313 - DNA, 735 bp, Homo sapiens
agggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 107314 - DNA, 916 bp, Homo sapiens
agggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacagtggacctggacatctcatcagcgtcacttcaaggttcactgatcctaaaggactgtttcttgttggaaggtcatctcaggacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 107315 - DNA, 835 bp, Homo sapiens
agggctggtcccacagtgagctacagccctgcccgctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 107316 - DNA, 446 bp, Homo sapiens
  misc_feature (53)..(53): n is a, c, g, or t
gcccgactatttttttcttccccacaccatatataccgaacacgcccccctantcacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaa

SEQ ID NO: 107317 - DNA, 188 bp, Homo sapiens
atgtaatttccttgccacatgctgaaatccatcagttgccccagaagtgtcatactttttattagaaaatggcatttgaggccgggcacggtggctcatgcctgtaatcccagcactttgggaggccgaggcaggtggatcacttgaggtcaagagttcgagaccagcctgaccaacatagtggaacc

SEQ ID NO: 107318 - DNA, 2467 bp, Homo sapiens
gcaatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccaaaaaaaagt

SEQ ID NO: 107319 - DNA, 579 bp, Homo sapiens
gcaatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggcgagcccacaccttaaccgtgctcttcatcctcacctgtacgcttggctatgtgacgctgctggaggaaacacctcaggacacggcctacaacaccaagaggtttgtctccacaggcaggcaggctagaccttgggtgtgtcctctgcctgaattccatggattctgacgccagtctcagaagtgcgtgtggaagagaagctggttttagagcctgtga

SEQ ID NO: 107320 - DNA, 2692 bp, Homo sapiens
agatgatcctactgcctcggctcccaaagctctggaattacaggcacaaatagtttacatttcatggaggcaagtcctgggcaacatgctttaagtgcatgttcacttaattttcatgatgtccttggaagtcagaagcttccccatttagatatgaggaaactgaggcacggaggggtgcatcatctctccaaggacacactccagtggatgtaggacctgggttagacgtgaggacacactccggtgaatgtaggacctgggttagacgtgaggggacactccggtggatgtcggacctgggttagacgtgaggacacactccggtggatgtcggacctgggttagacgtgaggacacactccggtggatgtcggacctgggttagacgtgaggacacactccggtggatgtcggacctgggttagacgtgaggacacactccggtggatgtcggacctgggttagacgtgaggacacactccggtggatgtcggacctgggttagacgtgaggacacactccggtggatgtcggacctgggttagaacgtgaggacacactccggtggatgtcggacctgggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccaaaaaaaagt

SEQ ID NO: 107321 - DNA, 1486 bp, Homo sapiens
cagggttcggtgggctgccttcctcaggctgccggctctgtggttcccaggggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccaaaaaaaagt

SEQ ID NO: 107322 - DNA, 729 bp, Homo sapiens
actgtgttacccagtctggtcctgaacgcctgggctcaagcaatcctcttgtctcagcctcccaaagcgttgggactacagacgcgtgcagcctacaaagttttatcagatatatgtattgtgaatattttctcccagtttgtgacttgccttttcatttctttagggcacaaatagtttacatttcatggaggcaagtcctgggcaacatgctttaagtgcatgttcacttaattttcatgatgtccttggaagtcagaagcttccccatttagatatgaggaaactgaggcacggaggggtgcatcatctctccaaggacacactccagtggatgtaggacctgggttagacgtgaggacacactccggtgaatgtaggacctgggttagacgtgaggggacactccggtggatgtcggacctgggttagacgtgaggacacactccggtggatgtcggacctgggttagacgtgaggacacactccggtggatgtcggacctgggttagacgtgaggacacactccggtggatgtcggacctgggttagacgtgaggacacactccggtggatgtcggacctgggttagacgtgaggacacactccggtggatgtcggacctgggttagacgtgaggacacactccggtggatgtcggacctgggttagaacgtgaggacacactccggtggatgtcggacctgggttagacgtgaggacacactc

SEQ ID NO: 107323 - DNA, 1989 bp, Homo sapiens
gcaatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccaaaaaaaagt

SEQ ID NO: 107324 - DNA, 2576 bp, Homo sapiens
gcaatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctgctgcgaccctgggctggccctttgccgatgctcctctgtgagaaggatcaagccgtcgacctgaaagcaggcttcgtgagaggagggtttggctcttcttgactgcaaggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccaaaaaaaagt

SEQ ID NO: 107325 - DNA, 2031 bp, Homo sapiens
gcaatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccaaaaaaaagt

SEQ ID NO: 107326 - DNA, 253 bp, Homo sapiens
ggttcgcttcgagtggaagccggcctccagcctgcgtcgctggctggccgtgtgcggcatcatcctggtggtaaggccgggctgcctcgcgacggcgcggcgggcggggggccagagctggtgctcaccctctcctcccctagttcctgttggcagaactgaacacgttctacctgaagtttgtgctgtggatgcccccggagcactacctggtcctcctgcggctcgtcttcttcgtgaacgtgggtggcgt

SEQ ID NO: 107327 - DNA, 374 bp, Homo sapiens
ttgaaaggagtggtagaaacagagggggcagcagcctggaggcttgatccacggctacagggaagaagggtcagaggaaaggtttctggtgcccttgaagtctcccaggctcctcaaaacccagggagtaaaaaagcagaggagaggtcatgcacacagggcagagggcactcgggcctcgcggcactcctggggcacaggcttcagaagcttccgcttaggaatctgagaatggttttccactgagacagatgtgagaggaaaaagaattcctaggtctctccactcagaagtcggaggaaactttcagaaatgtaaagtgggtcatctcatgtgctgctttaaactcttcctagcttcttgctgctctcaga

SEQ ID NO: 107328 - DNA, 258 bp, Homo sapiens
tccttttcactgctgtgtgatatcccattgtaggcaaatagtacacaatatttatttattttccagatgggatctcattctgtcacccaggcttgtagtgcagtgaccccatcacgattcactgcagccttgaactcctgggctcaagcaatcctcctgcctcagcctcctgagttgctaaggccacaaatatttatccattttactgctaatgcaatttgagctgttttcaactttttcctattaaaacattattgc

SEQ ID NO: 107329 - DNA, 449 bp, Homo sapiens
taatctcctcgattcaggctagcaacaaaaagacacaaatagtagtgctccccaaacttcagtgtgctctgaatcccctaaagatcttattaaaatgcagattccgattcagtagatctctggtacggcctgagatgctgctgttctgtgaaccttgcttgactagcaagggatcatctaaagattctaaccacgtgcctggctgcccacctgggactaatgaccactaacaaccttaaaatcaaggtacattttctacagccagtttctcagatgttccaaccccataactgacctaccggaaatgtacgcctgcaataccattaacagtgggggagaaaattatggaactggaaactgtatttaaaaaaaatgttgaaaatgaagcacagagagctaagtagatgaaaatagggaagtttaaaaaactcaaagagatttaaaaaaac

SEQ ID NO: 107330 - DNA, 921 bp, Homo sapiens
ggactattttagaagaaatggagctgtcacccacatcaagattcagaacactggtgattactatgacctgtatggaggggagaaatttgccactttggctgagttggtccagtattacatggaacatcacgggcaattaaaagagaagaatggagatgtcattgagcttaaatatcctctgaactgtgcagatcctacctctgaaaggtggtttcatggacatctctctgggaaagaagcagagaaattattaactgaaaaaggaaaacatggtagttttcttgtacgagagagccagagccaccctggagattttgttctttctgtgcgcactggtgatgacaaaggggagagcaatgacggcaagtctaaagtgacccatgttatgattcgctgtcaggaactgaaatacgacgttggtggaggagaacggtttgattctttgacagatcttgtggaacattataagaagaatcctatggtggaaacattgggtacagtactacaactcaagcagccccttaacacgactcgtataaatgctgctgaaatagaaagcagagttcgagaactaagcaaattagctgagaccacagataaagtcaaacaaggcttttgggaagaatttgagacactacaacaacggagtgcaaacttctctacagcgaaagaggtcaaggcacgaaaacacaagagaaaaaaaaccgggatcaatgccgggggccgaaacagaggtaatgaaggccatggctagggtcctggccagtttctgtcacagggtcgattgcgccctaaggagaggctaatccgaaccggtacggtgaagccgcacgaacaacggaagacaccaacagtacatatacaaaagaggacaacccactcaacaccaaaaacacgagagaaccacatctacatgcacaa

SEQ ID NO: 107331 - DNA, 265 bp, Homo sapiens
gttgagtgtctgcccagtgagaggatgaatggatgaacgtgaattcattctttaaaaataaaactagaacttcattagaataatgagatgcctggaggggtggaccaagggatggagacagatgtgagaaagcaggcacagcgaaatgcgaagggtggaatcaagctggtgcgtgtccaggcataaaattctttcaactctgctgcacgttcaaaagaaaaatgctggcggaagaccttgagcatcctccatgctgacatgtaac

SEQ ID NO: 107332 - DNA, 428 bp, Homo sapiens
ctagagatgtgaatgaggaggtcattagcatatttatggtatctaaagccatgaggtccctaaggcagtcagtatagataggcaagaaaaatattttagaccagagttttggtgctccagtaaaatattttccattattttatctcaatgatttttatgtttcattatgaacttttattcaatatttggcttaacttaaaatgtttttctattcccttctagaacttcagctcacttaaaaaatttttctgttttgtttggtatactgtattatgtatttaatggagaagaaaaatcttagacaaattaaatttaacgtaggttacttgagaaacgaattattcttaaattgggaagcccctgaaccagcacaggttcagaactccagtgctgcacatggtggaagatttatggacagaaaaaagaaa

SEQ ID NO: 107333 - DNA, 441 bp, Homo sapiens
gttagtggctggcaactaattaggtgactggcaactaaaatttcttatctgttgcaagagtatctcctatttataatggttatccagttgtttatgtacaaataaacgtttttataagatactttaagaaaagaagttatttttctttaaaaaggagttctgttctttttaaaatggaatctgacaggatcttttgtttttaagaagtttcattctttttttaagcaaaaactacagcttggagttttttaaatacatagtgaatgttttgaccaaatacatgtaattttacttaaactattttaacaatgacttttctaagtggaagaccctaatagaaattgacatgtcctagtcagtgatatggactgagaacttgataacaaatcccactgctggctactaagaagctttatcgggtttaatagggaaaagccttgt

SEQ ID NO: 107334 - DNA, 599 bp, Homo sapiens
atttttggatgcacttttgatgggacccaacaagagatgatttgtttatttgggaagaatcctggcatgcagtgaggagcacctttgtagctagaacatgcttagattttggtattcttgaaaatgtggcctcctccccaatgccagtgtaaaggattaaaaaaaaaacaaaaaaacacatctcaaaccttggcatttattgaatattaacaggccaggcaccaaagcattattcagcattgacacttaaacttttctgtattgattattattattattattattttttgagacaggatctcactctcttgcccaggctggagtacagtgacataatcttggctcactacaacttgtgcctcccaggctcaagtgattctcttgcctcagtcttttgagtagctgggactacaagctcgcaccaccacacccgtctctactaaaagtacaaaaaaaattagctgggcatggtggcgggcgcctgtagtcccagctactcggcaggctgaggcaggagaatagcgtgaacctgggaggcagagcttgcagtgagccaagatcgcaccactgcactccagcctgggcgacagagcgagact

SEQ ID NO: 107335 - DNA, 315 bp, Homo sapiens
agccctctctcccacccagagctgcttcttgtgccctctgccagaggatggcaatgtcacaggagcaagggagctgcacaatgcccagaggtttatgaaaatacgtatctgaaaaagggaatgctgtgcagagagtggtcgtgtgggcaggcctggtgcatgggagcaattagagctctgggtgggagagagggctccgccaattttccctgtgtgaatgagcaacacagaccccatgtccaagggggtagcaggatgcaggctcagcagggccttgaaaccaaataaaacatttgtggggtgggtggagagcgg

SEQ ID NO: 107336 - DNA, 362 bp, Homo sapiens
atttattttttgagatggagtcattctgtcacccagcctggagtgcaatggcacagtctcagctcactgcaacctccacctgccaggctcaagcgattgtcctgcctcagcctcctgagtagctgggactacaggcatgcaccaacacacctggctaatttttgtatttttagtagagacagggtttcaccacattggctgggctgatcttgaactcctgacctcgtgatccacccacatctgcctcccaaagtgctaaggggtgaaccaccgcacctggcccatttcccctttctttaccatatattctttacattaaatataagggtaataagtggcgggaaatggtatggtagaaaaaa

SEQ ID NO: 107337 - DNA, 180 bp, Homo sapiens
acaaagactctaattcaaaaggtctgggtagatcaaggaatcttcatttttacaagtaaccaaggttcagatttaaaaatcactgctgttaactatgaacttccaaaagtctaaatccagagaatttatcttcaaccacaccctgtgcaaaaagcatgcctgtccaaaagctggtgctca

SEQ ID NO: 107338 - DNA, 685 bp, Homo sapiens
cttgttatagaagcaggatcttttgttctgtaggaagtcacacattctggtttcatatgctcttctttaatgtgttccttcaccactcttattttttcttaagggatgctgtctctaaatttgatttaacgtaaatgtttttggcaagaatgctttgcagagggtgtctttactacgtttattaggaagcatccactattcagaacctgttttattgaagctgagattcatcattggttttggcaggtaacagactgactattccattttaaagttccatattaatttttcatgtgattgtttcttcaattgatgattgttacttaaatcaattatgtcattaagtaattgcaaaaatcatgatttctaattctgttaattattttccatttgtcaactagactttttctgtaaagaactttccctgactgactaggactgtttggagcgcacttcttttccttgacttagatttgtcctacgcaataattttagtgtggtgttttagtcccttttgtgctgctataatagaatatgtgagactgggtaacttataatgaatagaaatgtatttgtctcatggtcctagaggctgggacatctaagatcaagggtctgcatttggcaaaggcctacttgatgagtcatccaatggcagaaggataaaagacatgcacacatgagt

SEQ ID NO: 107339 - DNA, 1039 bp, Homo sapiens
catgcatatactgctatcttctactttaccagttttgcgcattagtcttacaaccatggtagatgagaacgtttctgtgtagaaccaaaccactcattcagtctcatcaccatcacccaaacatagcctatctctgttaataaaactaatagcatttacagtcatgtgactatgcaatagctgtcatgactcagtcgagtggtaccctatgagctgcctcctttcttctgcagcccttcatttttcctggacttaataattgtcttgcattttatttgatttttcatattcttactactaaatatctttctgtatcttccagtaaccactgtagagtttttcacatgatgaaaacatatggtcacacatacggtctgatagttcaggttttttctatctttatgctccagtctagactagttcctctgtaaacgtgctgtatagctctcagctgggacttcccttttgccattattctatttcctttggctgtctactatgtcacatgtttcctagatgccacattttcttctttctcaattaatcttcctagagcacatcctccagtaaattcctgcgaaaaggtgtgtgggaggcaccctttgaggcttagcatgtctgaaatgactttgttttgccttctccccagtagagaatttggaatgtgggggagggaatgataccctgttttattttgcaggagctccctcatcttccatttcttttgtggacatgatctggtgtgtctctgagattttcttctgcttttttgtattctttgctttctctgtattccttttttctagctatcctattttcttggaggttttttctttagtgttttatataaggcattctttaaatatccagtgttcctttcattgttttccactcttaggaatagagaaatgaagataatggatttaactagaagacagtggggtaaagggggggataaattggctcttaaattttctctcctgtcccacgtcattctgttcttttctataattaaatatccttagagaagaatccctgt

SEQ ID NO: 107340 - DNA, 1514 bp, Homo sapiens
taaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttaaaagttg

SEQ ID NO: 107341 - DNA, 1239 bp, Homo sapiens
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107342 - DNA, 1227 bp, Homo sapiens
ctagaattcagcggccgctgaattctagaacgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107343 - DNA, 911 bp, Homo sapiens
  misc_feature (764)..(764): n is a, c, g, or t
  misc_feature (766)..(766): n is a, c, g, or t
  misc_feature (771)..(772): n is a, c, g, or t
  misc_feature (783)..(783): n is a, c, g, or t
  misc_feature (788)..(788): n is a, c, g, or t
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggctggaataattgaggaaggctgaacagtggaggaagttgcctttggaatgatccctaaaggactgactggtaggatttcagaaggtggtgatggggatggagaacattccagatagagaggagaaaagacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtatccttttntnccccnntgtttcggtcnggganaagggccattttcttcgagggcggttaactaacgggccgaaaatcgtcaaataacgtggagtgagcggggcgcgtaacaaaccaagagggccctgagaggggagaacagacctaagggcaaag

SEQ ID NO: 107344 - DNA, 702 bp, Homo sapiens
ggatgtgaaaaatcttttttttttttttttttcagttttatgtagagactaggtatcactatgttgtccaagctggtctcaaagtcttgggttcaagccatcctcctgcctcagcctcccaaagtgttaggattacagaagtgagcttcggcgcccagcctgtattactttccttgtttctttctgttcttgttgttttttgaaatggagtctccctctgttgcccaggctggagtgcagcgatttctgctcactgcagcctcacctcttgggctcacgtgaccctcccacctcagcatccctagctgttcaaatttattgtccaactcttttgaatcgtttatcaacgcaaatctgtcaatgcccacttatttttatttatttttttgaggcggagtctcgctctgttgtccaggctggagtgcagtggcgcaatcgcggctcattgcccctccgcctccccggttcaaacgattctcgtgcctcagcctcccaaatagctgggattacaggcgcgcgccaccacgtccggctaatttttgtatttttagtagagacggggtttcgccatgttggccaggctggtttcgaactcctgacctcgggtgatccgatcgcctcggcctcccaaagtgctgggattacagacgtgagccaccgcgcccggccctcatgaacttattctttagcgtttcattttga

SEQ ID NO: 107345 - DNA, 1605 bp, Homo sapiens
  misc_feature (1249)..(1249): n is a, c, g, or t
  misc_feature (1418)..(1418): n is a, c, g, or t
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagaaaaaaaaaanaaaaaaaaaaaaaaaaaaaatttgggcggcgcgggcacgggcgccccgggagaagaagtctttctaaagaaaccattttgggttgggggggcgcgagcggggccccggtggaggtaacgggagaaaagggtggtccaagacggggtcccccgagggaacactcgcgggngcggcaacgacgcggcgtgggatttcccgcacaaatataaaaaagcgccgggggggggacaacacgggagcggtcctggaaaaaaaatccccagagagggggctcgcgagggcccaataacggggatcgataacaggagaggatcccaggggaagcccggaattaaaataagccccggagagggggg

SEQ ID NO: 107346 - DNA, 1090 bp, Homo sapiens
agtgacgcgcgacggttcgtgcgtgcgtgcgggcggctgcgtcgggctgcaggagaagatggcggtctccacagacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107347 - DNA, 1435 bp, Homo sapiens
gcagtggtatcaacgcagagtggccattacggccgggggcgtcgggctgcaggagaagatggcggtctccacagagtcactcatgtggttgcatcagctggtgaagggataggcttgttgcccgggacgccttgctccccctccctgcagcctctccaggtggccagttaggacttcctcacatcccggtggtgtcagggtgttcagaattcttacatgatggttggcttccaaaagaacgaaagcagaagttagcattcctcttacaaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107348 - DNA, 1203 bp, Homo sapiens
agctggataaaatgtccgtctccaccacgcggtcacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107349 - DNA, 1337 bp, Homo sapiens
agtgacgcgcgacggttcgtgcgtgcgtgcgggcggctgcgtcgggctgcaggagaagatggcggtctccacaggctggtgtgcaatggtgtgatcttggctcaccgcaacctccacctcccgggttcaagcgattctcctgcctcagcctcccgagtagctgggattccaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107350 - DNA, 1222 bp, Homo sapiens
atcatacagtgagtcctagagcgagatcgaatgatcaaattacagccccagtcctgagagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107351 - DNA, 1367 bp, Homo sapiens
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggctggaataattgaggaaggctgaacagtggaggaagttgcctttggaatgatccctaaaggactgactggtaggatttcagaaggtggtgatggggatggagaacattccagatagagaggagaaaagacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107352 - DNA, 1291 bp, Homo sapiens
cgttgctataccatgcgttgggggcgcaaggatcgcgaggactctccacgtgaaacttggtcttacgtctgtaatctacgggcaatagtccgggatcatgttgtaggtagcgtggcgaatctcgacctagtcaaagagtgcccgtggagctggcgggcgtcgtacgtgtagaactagaatcactagtggtggcttactgggggcatcgcgtggtgacttatcagaggaggagatccggagcgagcttctgatatcagattatagtccgcgtgaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107353 - DNA, 1223 bp, Homo sapiens
tgctgaggatacagatggcggccccggaacccagagaaataattccaatcgatggtcatcgcttggttgctagaactaagcctgaaagcgatcgataggtggctaggctactggatccagtaagctgggcgccgtgtggaaatccaggacgttctgaacaaatttccaagaggtggactgcgtcgtgagtcattagctgcatctatgacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107354 - DNA, 1273 bp, Homo sapiens
  misc_feature (45)..(45): n is a, c, g, or t
ggagagcaggcgcgtgcgtccctgcggcgcggatgtaatgtgacntagtgggagtaagcatggtggcttatcgagagtgatgttatacatgacctacgtgacattgtactgcttatcggatagaacttgacaccaaggacaacacgggacgtacgtgaagagatatccgattatggtggtgtcgtggtcgattgactgaatatatgaacacatgtgcgtcgtggcagcaggccgtgattctgtggacgccacagggcacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107355 - DNA, 1283 bp, Homo sapiens
  misc_feature (77)..(77): n is a, c, g, or t
taggatcgattcgtggcggcgcgcagaacactggtgggtacggtgaggatggtcatttcctgctgttcctatgcagnatcgctgggtcatagacctagatagcataggacttacatacagcgcagttaaagcaggaacggccacggtgtgagcatcgcggagccgttgctagaatcgatagtccgagtatggaacgattctagacaggtcgtaaccattgcatctaatctagaggcacgtccaaggcagcaactcgctgatcaacatacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107356 - DNA, 1563 bp, Homo sapiens
gcagtggtatcaacgcagagtggccattacggccgggggcgtcgggctgcaggagaagatggcggtctccacagagtcactcatgtggttgcatcagctggtgaagggataggcttgttgcccgggacgccttgctccccctccctgcagcctctccaggtggccagttaggacttcctcacatcccggtggtgtcagggtgttcagaattcttacatgatggttggcttccaaaagaacgaaagcagaagttagcattcctcttacaaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggctggaataattgaggaaggctgaacagtggaggaagttgcctttggaatgatccctaaaggactgactggtaggatttcagaaggtggtgatggggatggagaacattccagatagagaggagaaaagacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107357 - DNA, 1148 bp, Homo sapiens
tgggggcacatcgagcagttactgaagcataattcccagcatggcagttgctgagcgtcgacttagctggattcgtatcaccaggagtccaatgcgtagctcgcatatctatattacgctgcacagagtctgacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107358 - DNA, 1292 bp, Homo sapiens
gcaacttgggatcatattgataatactttgtagaattaattttgtaaaatctcatggaattaattttgtaaaatctcaatttttaagtatgcttattgcattttttctcaccatataggtgaaataaatttgaatgtagaaaaataaattcttaatcataaacactgtcttacgtacattcatattgtactttcccttttttttttttagcacttagacattaatattttaggtattgttattttgattatctttttgttttttgccttccagacaacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107359 - DNA, 1235 bp, Homo sapiens
agctagcatagaagcatgcgtccggagcgctgaccctgccatgcgtaagtgaacgtgtgtcatagctgttcgctagaagatcctggtgcaatgtactgacgtgcttgcattctacactgaagtcctaaacgcaccggtggaagatatgagcgttctcgaggtgagtccaaggatggaagtactgggagggtcaataacggggcatctattctagaccagcgagacactatggtagagcgctggatagtcgaatgaggccctaacttggaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107360 - DNA, 1496 bp, Homo sapiens
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatgccagtgggatgagtctcactctgtcacccaggctggagtacaattgtgcgatcttggctcactgcaacctctgcctcccggcttcaagtgattctcctgcctcaacctcccgagtagctgggattacaggcacctgccatcatgcccagttaattttgtattttgtagagacggggtttcacaatggccaggctggtctcgaactcctgaccttagttgatccgcccggctcggctcccaaagtgctgggattacaggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107361 - DNA, 1113 bp, Homo sapiens
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaagggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107362 - DNA, 1271 bp, Homo sapiens
  misc_feature (476)..(476): n is a, c, g, or t
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgcacaaggcctttttcccccaancaagggccccaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107363 - DNA, 951 bp, Homo sapiens
tgagcggtccgattgcttagacacaaaataatatgaacggaataaatattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107364 - DNA, 1116 bp, Homo sapiens
agaccatcccctgctggcacgcgatcccagatatgtcaggtgcccatgtggtcatagcctgtatcctaggagaatcctggtcatgactagttgcttgcaataactactatcaacagaaaatgcccgtgtggacctcgacagtcatgaactactccgagatggagtactggtcgttcataactggatctatcaagcagtgagttccatgccgagtcgtcgatatcgaatagcccggccccgatcccgagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107365 - DNA, 1178 bp, Homo sapiens
gcagtggtatcaacgcagagtggccattacggccgggggcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaatcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107366 - DNA, 583 bp, Homo sapiens
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgagacactcggggtcctctagatcgactc

SEQ ID NO: 107367 - DNA, 1261 bp, Homo sapiens
tagaggacccccttatttccttctatatagggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaa

SEQ ID NO: 107368 - DNA, 666 bp, Homo sapiens
  misc_feature (310)..(310): n is a, c, g, or t
  misc_feature (479)..(479): n is a, c, g, or t
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctacattaaaatctacgtttctgacgatggcaaaaaaaaanaaaaaaaaaaaaaaaaaaaatttgggcggcgcgggcacgggcgccccgggagaagaagtctttctaaagaaaccattttgggttgggggggcgcgagcggggccccggtggaggtaacgggagaaaagggtggtccaagacggggtcccccgagggaacactcgcgggngcggcaacgacgcggcgtgggatttcccgcacaaatataaaaaagcgccgggggggggacaacacgggagcggtcctggaaaaaaaatccccagagagggggctcgcgagggcccaataacggggatcgataacaggagaggatcccaggggaagcccggaattaaaataagccccggagagggggg

SEQ ID NO: 107369 - DNA, 395 bp, Homo sapiens
tgaactttggcttctatgaactttctgggcatgcctgtttgattggtgcagagtccttggctgtaacagaaacatcaaatagggaaaacgatttccttatggttgattgacttacatcagtataaaattgatgaggaatttatatacacgttgtatactgctgttaatgtttggtacagtgctttctttagtgttttcattttgaggggttattagattcagcattttctggagcagaatgctttttaaaggggatttggtctttttgggaaataatttataaaggttaatttggaaaaagctgaatttaaatacgtgtagctcttataattatgagctttttacatttacactgacgttcttttgtatagggagttaaagttcctcgtaatttt

SEQ ID NO: 107370 - DNA, 768 bp, Homo sapiens
ttatttttttgaggcggagtctcgctctgttgtccaggctggagtgcagtggcgcaatcgcggctcattgcccctccgcctccccggttcaaacgattctcgtgcctcagcctcccaaatagctgggattacaggcgcgcgccaccacgtccggctaatttttgtatttttagtagagacggggtttcgccatgttggccaggctggtttcgaactcctgacctcgggtgatccgatcgcctcggcctcccaaagtgctgggattacagacgtgagccaccgcgcccggccctcatgaacttattctttagcgtttcattttgagagcgggattcacaagggaattgcggaaacagcagcgaggccccgcgacccctcggcccacgtgcgcgctgtccctcgggtcgccccgcgcccgccgggggcggagtccgctgtgacgcgtgcagggcggcgcgctcccggaagtgacgcgcgacggttcgtgcgtgcgtgcgggcggctgcgtcgggctgcaggagaagatggcggtctccacaggtcggttcccgggccgggctgcgtgattttccgctccgacccggctctgcccctccgtctgctgctggcgcccgagcgctgaccgtgcgggagaagcccgagtgcgctgtctcgaatgccgcgctctccgcagagcgtagcctgggaccgggtgggaccggcgccgaggccccggcggccgtcgggttggcgggtcgtgctcgcgcgtcggccgcgcgccggcgggct

SEQ ID NO: 107371 - DNA, 2263 bp, Homo sapiens
agtgacgcgcgacggttcgtgcgtgcgtgcgggcggctgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatcccattttttaaagcataatatcttttttagttgtttttctgtgaagcttttggttaataaatagggtcaactaattggagacttttctcttccaattagggcttttaatactaacaaggataactttattcattcctcgtattctctactctaacaaatatgaactctgaagttgaaaagtcatttatgttccgctttcaccaaagtgacgtgaggctttaggtcactgtttcacttcaaagtactggatccaaagctttgttgaaaatgctgtttgatgaattcactgaagaatatagaaaggtggtcaggtaaagtctacttttattttgtcaagcttaataatttgtgtcatactttaccccagtatatataggcaaaccaaaaccttatcaaatattaaattagttgtttaaactttgcttataaagtattggccatgtggtggctcatgccgctaatcccagcactttgggaggctgagacgggcagatcacttgaggtcaggagcttgagaccagcctggccaacatgatgaaaccctgtctctactaaaaatacaaaaaattagccaggtgtggtggtgggtacttgtagtcccagctactcgggaggctgggcaggagaactacttgaaactggcagacagaggttgcagtgccgagagcgcaccactgctccagcctgggcaacagagcaagactccatctcaaaaaaaa

SEQ ID NO: 107372 - DNA, 953 bp, Homo sapiens
  misc_feature (855)..(855): n is a, c, g, or t
  misc_feature (859)..(859): n is a, c, g, or t
  misc_feature (867)..(867): n is a, c, g, or t
  misc_feature (890)..(890): n is a, c, g, or t
  misc_feature (892)..(892): n is a, c, g, or t
  misc_feature (912)..(912): n is a, c, g, or t
gcagtggtatcaacgcagagtggccattacggccgggggcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctagtaaattctgaaaaagaaggggtggtccctctttgnaaanaggcgggnaggtaaagaaggacaatagcaangnttgaagggggcgaaacaaanggggggtataaaaagggggggggttttaggaattaacaaag

SEQ ID NO: 107373 - DNA, 1239 bp, Homo sapiens
gcagtggtatcaacgcagagtggccattacggccgggggcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcaga

SEQ ID NO: 107374 - DNA, 981 bp, Homo sapiens
  misc_feature (847)..(847): n is a, c, g, or t
  misc_feature (981)..(981): n is a, c, g, or t
gcagtggtatcaacgcagagtggccattacggccgggggcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccgtcagttagatttgtaacaaaaattaatatgaacggaataaataattccagtgggatggtggatgcccggagcataccagtgttagcaaaatggcaaaattcatatagcattaaagttgtacttcaagagctaagacgtctaatgatgtccaaagaaaatatgaagcttccacagccaccagaaggacaaacatacaacaattaattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaaggaaatttcgaaagaatggtgttncactttataggaaaaggggggaatgttaaaggcggagatggtggtgttcttgaaggggccaaagtacatgtgtgacgctacaagggggacagggcggagattagacgtgagcgtgtagacatggtagtaaatan

SEQ ID NO: 107375 - DNA, 718 bp, Homo sapiens
attgtaaggacaaaagggcaaatgatataaaacaggtattactattctaagtataatggaatggttgttacatctttagcgatttacccatatctgtatggaaatttattgtatgattctgaagcaatacaaccaatgactaaaacttggtcattaaatgttgtttggggataattcaatttccaattagtttgcaaactgattttagatctctctctcacagcatgggcttcctcacgacatgtggacaggttcctgagagaacaggttagaattatatggcatttttaggatctagactcaaaagttactaagcatcacttcttacatactctattggtcaaagcagttacaatggtccactgaggttcaagtgggaggaatccgatgtcaccagttgcagggaagatatcaaggtcccattgtcatcagaaagcatgaggtgagagatgatcttttggacgtttttggaaggtatgatctgccacacattgcaaattccaagatgttaaaaatgtaaacacgtgcatctaaaaatcaacaactgtggtaagaaatgtatggtagaatttcttatcaatgtcattaagcagaagagaagaccctgttctgagagaaaatctatgtgttcacttaaaagaaaagtaagtctgtcattaatcacttgaaaataatccctcttttaaagatatctgtataatgttataacaatatgagg

SEQ ID NO: 107376 - DNA, 360 bp, Homo sapiens
tgaggatcccccctggtatcccaccccaagctctcctcctgcacactcacctgaccagccactaacctgaccagccaacagggactgtaaactgtgaatgagctccaagccctctcacctagcatatcaccagctatttgaacttttcccagcaggcttgtcttataattgactttcggggaaaggtgaagtccagaagcatctactggacccagagggtatgggtaaggcctaattagggaggaaaagggctcccagagtgtgtatgctcagaaaagcagcactccccctcctctcccactcagcaagggttggcaggtaagtttcatatggggtggggatttcaaggctgcaagggtt

SEQ ID NO: 107377 - DNA, 341 bp, Homo sapiens
gataagggatatagggttacttttttggggtaattgtgggattatactacaaaattgactgtggtgatggttgcataactctgtgcatacaccaaaaaccattgaattgtacactttaaaatagtgaattgcgagatgggtggatcacttgaggccaggagtttgagaccagcctggccaacatggtaaaaccccacctctcctaaaaataccaaaattagccaggcgtggtggcacatgcctgtaatcccagctactcgggaggctgaggcaggagaatcgcttgaacctgggaggcagaggctgcagtgagctgagatggtgccattgcgctccagcct

SEQ ID NO: 107378 - DNA, 124 bp, Homo sapiens
tttttaaattaagagtcccaaagtcattcttctcagactgccttctaaaagcccaaacagcgaaatcaagagtaaaagcgccaagacggtgacccgggtctaggggattcccccctggaggcca

SEQ ID NO: 107379 - DNA, 296 bp, Homo sapiens
ggctgatgtcttgaatggtggcagtctgcatggaagtccaaggaagtattgtgaaaagccatcccatagagctgttttatcgagatatatccagatgtgaataaactggaaaagcagaaagcatggaaagttaccagagggagtttacctgaggcagccggtatgtgcaaaggagtaggatgacttggcctgattgggtgggaaggtttcttggctatgtatattgggacttttctttcttaagtagactttatattttagagcagtttcagggtcatagcaaaactgaacagatg

SEQ ID NO: 107380 - DNA, 135 bp, Homo sapiens
atgtccgtcttctgcaaatatgtgagtttgtttctcattggccaaagctgattcaaacagggctgctgtatttatcagctaggttgtgttaactagactttccagggacttcagaactgggacacaatcatttta

SEQ ID NO: 107381 - DNA, 431 bp, Homo sapiens
gttctactttcttctccattcccacacacataaacttcatgaaaataaactcagttatgtagcatttaaggcctattcagaaaggattcagttgtagtcagtcaatggaagaaccaagatagttaaccaagtcttaagcatttctctattcattcagcagcatttatcgaactgggtataagaaatagataaagccagcctctgccatcaggagcttgtgattggggagtaatgtgtgatgtgatctgtattatcacagaggggagcacagcatgtgatgggaatggaagatgggctcctagcgtggccttcttgggtcaaggatggcacgctggattggataactcaggggaagaactgattttatggaaattatccaaaggagttattcattaatttagcatctctcttccccagtctctgatgtgtgt

SEQ ID NO: 107382 - DNA, 567 bp, Homo sapiens
gtctgaggatcgcgaccggagcataccctttaataagccctttaaatgattctgatgcttgctaaagtttgagaaccactgggttaaaagatctgctcttaataaaaaccagcaccctgccagctcctgctgtcccgtttttcttccgtagcacttaactgcgtgacatcccatcccatcccatcccatccctctcttgccaatagaatgaaagcttcctgagactgggaagttttgtcagtttggtcattgctttaatcctagtgcctagaatagtgactgcatatagcaggcactcaagtatttgttgaatgaataatgtaagatgatttaattctatgtattgccagctgcgacattggggttttactcaagaaccgttctcagaatgaataggaatcatggtccaatgtgcaaatccaaggggatcctaacatttttgggggattcattttaggttgagcttttccctttatgtgtctccaaccaaagcctgcaagaatttttagcctagtcttttgttcgtttgtttgttttaaccaccacctgaaaactgctgttgcaata

SEQ ID NO: 107383 - DNA, 375 bp, Homo sapiens
ggcgtagtaagtggggtaaaggcgctgaacataaactgcaaagggtcctgtcctcgtgaaacttaaagtctagtgggaaagacaggaaatacataaataactacatactttattgtcaggtagtcaaggaaaaaaatcaggttacttctttagatagcagtggctagttagggcaggtgtctctcttagaagctgatatttgaacaagagaagtgaaagaagggcaggggcaagccatgtgagcatctgggaaaggagatccaggcagagaacggagcaaactcaaaggccctgagttagtattgtgcttagtgtgttgggcggcgaacaccaggaaatcagtgtagccacagcatagtggtcacgggcaatgga

SEQ ID NO: 107384 - DNA, 406 bp, Homo sapiens
tcaggctttcccagaaggtgagcaagccctgattctttgccttgcccagctggagagaacatataaggggcaatgcagagcaatggtgctgtcttttgatgtgctgttgaactgccttttgcagggaggattctgccccttgcattgtggatgtgaaactgtgattaaaccttcaatgagtgctgctttactaggcaacgcggggacagtgcctggaatctagtcagttcattgataaaactcgaggttgaaagcatgactgttcctttgtgtaagtgcatccaggccttattaacgggccactgcccaactctgccatctgattcagccactgactaataggagacattgcagaggccattttaaagtgcctacaagggaagcttttaatctcttattggaaaat

SEQ ID NO: 107385 - DNA, 761 bp, Homo sapiens
tcgtattcccactattcctttctttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctcttattttgaaataaaaaagatacccacttttta

SEQ ID NO: 107386 - DNA, 740 bp, Homo sapiens
tatttttactgtactttttctatgtgtagatatgtttagatacacaaatacttaccattatgttacagttgcctacaatattcagtacagtaacatgttgtacaggtttatagcctaggagcattaggctatatcatgtagtctaggtgtagtaggctttacaatctaggtttgggtaagtacactctgatgtttgcacaatgatgaaatcacctaatgatgcatttctcagaatgtatccttgttggtaattgatgcatgactatatttagttttcatgtctcttttgttttccttaatctgaaaaggtcactcaacctttctttgtctttcattaccttgacatttttgaagagtgtagggcatttattttgtaaaatgtcttgcaatctggttttatctgatattttcagtttagattcagccaatgcattttgacaagaatataacagaattttgtgtccctcataatgtataacatcatgaggcacagatgacgtttgacttgttcatgatgttgcgtttgatacttggcttaggtggtgtctgccaggttttgattatagagttatttgatccccaaaattaaaaatagaattgccatatgatccaacagttcacttacgggatatacctctgtaagggctgccataacaaaatgccacaggctggatggcttaaacaacagaaattgctcacgtttctgaagtctagaatctaagattaaggtgctggcaaat

SEQ ID NO: 107387 - DNA, 452 bp, Homo sapiens
attcaggtgagtattgatttttatcatcactttgtaggtgatagttataaaagttaatcctcaagaacagtgtttttcagttaatgcctgggtctcatctcagacattctaattgttttgtgttttaagattttctaaattccgtggacgatttttattttgcagcctaatttgggaactttgtgctctaggctgtttattgcagtagagattctttacctgcaattagcaagtgctgccaccaggggcgtgggggtgtgcatgcctttattacttgcggcttcttgatctgaataacttgactggtgtctttaaaacttaagacctgtgtggaaattatcacatgtacaatgagaataaacactctcagaatacaaagagctcttactaaatcaaagagaaaaagatgaaccaatagaaaatgggcaaaaaataggaatagacatttcaca

SEQ ID NO: 107388 - DNA, 314 bp, Homo sapiens
ctcgcgaggtgtatcctctacgttatcctctcttccaccctcaccccagaagacgggacatatctggaccctagctcaggggcatgctgatcaatttatcaccaagctcctgccagctgattctttctattaaaggagagtttgagtcaaggaaggagctcctggtctctcctgacctctttggttgccagttggctggccaggtttatcaaggtgaatatgtggaaaagagccagagagctggggatgggggatgtgagtaacagtgcatctactcatgcatgcacctaagcaaacaggatagacagcgcaat

SEQ ID NO: 107389 - DNA, 172 bp, Homo sapiens
acacaaggaaacatgtcttaaaatgttcactaaagaactatttcttatagtatacaaagaaactgtgactcaggaggggaataaactagtttagtcaaagaaatactatacaacagtctaaatgaatagatttatatatcacaaaaagatacatgcaggacaagaaggaaaa

SEQ ID NO: 107390 - DNA, 663 bp, Homo sapiens
aagaaatcagtagtttcacatgagtctggcctggctgcagagcagcaagcaccctaaagtggtggagaattagtggccaggcttcccttcactcttccacttctctatcctggcagccccccacaaaggatacctttagggtcataatcatccatattacatgaaaagaatcttagtcattgtgaggaaaagatcagctagaaggggatgaaggtgaagagaaggttctttggagaggttcttagagacatcagatttcctgagaatctgatgaaatcagatctctattatacagaagccatggatgttacttttttttgagtagagagccatgatgtagaaagccatgttttcttttcattcttggcccctagtattcgagggtatcatctttctcagtcacagcctttcctaacctctgccctcttccaggaagaaagggatttggttacacacagatgatttcccagtcaccttgtttccatgagtgatcttgtcatttttaagctcaattgatgtattaggtttgaatttgtttgccagatacttgaaattcacttttctttggtatactggttttttagcattaacatggattccaaacaaacttggttctgccaaagaaaaccagagctggacagttgttaaaacagtaaaaaaaaa

SEQ ID NO: 107391 - DNA, 366 bp, Homo sapiens
tgttggctctagaggctgagtgactagcatcatgtcaattagtactgagtctagcacatatggagtctcctcaagcatttgttgaaatagttcattaatgtggtcagtttcagagccagggcctggcagcattgtgcagtgggaaaacccagatgaagagacaggagactcagcttctggtcaaagttctccctctaactagccgtggggccttgagtaagacacctcacctctctgggcctcagttttctcatccgtagaacaagagtatagaaccagatattctaagtctctccagttcactagggttgccccatccccctccagaatccctgtgggcatgctgtcatgggccaagccaggtgc

SEQ ID NO: 107392 - DNA, 679 bp, Homo sapiens
gaatgattatagatacgagatttctcctgagtctttccccactctggtcacaggcaatgagagctcaccagactctccttctcacggcagcaactgctcccactaccttttttggcaagcaatgagcagttcagccttttctccacccccaccccaccccccacttcatccccagtcaaccatgaggccctagttaaaagaggggctcctggaggcaaagatgctgagtcgactcctgagtccactgcagactggctgtgtgacctgggaccagttactctgcctctctgttcttcaatttactcattcgttaaaggggattaatctctacttcatggggcttttgtaaggattgaggactcattgaagataagttcccaatattacctattaaccagtgtctctgatgttgttttgcttctgagtttgacattgactatttcatccctaaatgaaatagtcccccctctactcctccttcccaaactccacttcaaaagtgcccaaacctttccaatttcaagaaacctcacgaggttcttgtcactctggcacaccctcacatcccacaaggtgcttggcaattgcctccgctaactgatcatccttttcccacgcactagcattttacttgatgggtgtgatggttgaactagccttaccaggagcggcaagaaga

SEQ ID NO: 107393 - DNA, 689 bp, Homo sapiens
gggggaagcagttgaaatgaagtgttggaatttcagagcttgcattactggattatgtgtggattgttgtttgtactgcctctttcttcctcctgctacctcatataggtgcttgatatctgattattacagtctttttaggggttcttgaacatactcacttgtagaaaagtgctggttaaaatcataacaggcagacatttgggttcttatagccttgcaataaatggaaggaagtaacttttgggcttatgaaaatgtatactgcaaggtttttctttctttctttctttctttctttctttctttctttctttctttctttctttctttttcttccttccttccttcttccttccttcctttcttcctttcttccttccttccttcctttcttcctttcttcccttctttctttctttcttgagacagggtctcgctccatcacccaggctggagtgctcactgcaaggatcctcctgcctcagcctcccaagtagctaggactacaggcatagccaccatgcctggctaacttttcttattttttgttttatgtagagacagtatcttgctgtgttgcctaggctggtctcaaactcctggcttcaagggatgcccccaccttggtcttccaaaattctgagattataggcacgacccaccatgcccagtggttttcttaaagt

SEQ ID NO: 107394 - DNA, 305 bp, Homo sapiens
ccagtttgcatctgtggtccgtctttagcaaaagtttgttcttagttgtcgtaattctgctttgatgtattctgtgatctcagtgatgtcctgagggctgtcatgtccacggtcataatctataactctttttctagttattataggtcttgccacatgcgcccgcctcccagggtcatcataatctcccgggtcctctggatggggggtttggtcccagacattccttttcaaaagttacatctgaaaaggatttacttttgcttaaaattctatgaacgacctctttgcctttctggtgatcc

SEQ ID NO: 107395 - DNA, 321 bp, Homo sapiens
agtgatagtaacaatagcctcatctcaggcaaacagagactgagtcacctgctcaaggtcaccctaactagcagagtgggaagttaaacccaagccttggtgcctaaccactgtgatccactgttatcttggcccctgggcacttctgattattgctgagctgattttgatccacccctcctttcttggcctcagccctgccatattactaagtctgctcccacccccacatttatttatttatttattttgagacagagtttcactctttttgcccaggctggagtgcagtggcatgatctcggctcactgcaacctctg

SEQ ID NO: 107396 - DNA, 151 bp, Homo sapiens
tcttattgtgggtgggttaaggtcaaaaaattctgaaagcccctgcattaagagcaagaggactatttacttccaaggctacttaagaggccttgaaatgtgagatttatactaaatcatctttgcataaagttatttgtctttttttttt

SEQ ID NO: 107397 - DNA, 438 bp, Homo sapiens
aatatttataattcttgaactaaacttttacatgccaaatgaatattttaatcttccacttggagaatacgtttacaggtaggaagttatttcagtacttagttttccaaaaactttagcttatttaatgcagtcaccattctcctgataggctggtcttacctataaaataataaagattagctcatgccttctggagaataaaggtctcaatccttaagtgggctatcaaccagtaaatgtgtaaggaataatgtagttagaaaatcattcatggatgctaaacctagtgaatgaaagtttgaggaaaaacatgatatttacacatctcaaaatacacctccccaaataacttaatttcatgggaaaaataggcagactccaccttaaccaagtaagtcttctttaatctccctgattggtctaactgcttaattg

SEQ ID NO: 107398 - DNA, 229 bp, Homo sapiens
aagcgtaataatttttaaattatattttcaactcagaatagaggtttggtggctgaaaagagcaagtccgaaatgcaaacctgaaagcaatgaaagcaggtaagaggctgagtgggctcgcctcgagtctggagttgcggtgtgtgtgttaaccctaaaacatcccttcgcacccgtcaggagagaagagacagcccaagtccagcaccagtccccaaagccaaggatg

SEQ ID NO: 107399 - DNA, 300 bp, Homo sapiens
ccaccttggcctcctaagtagctggggtgataggcatgagcccaccactcccaggtaatttttaaatattattatttgtagagacagagtctttctatgttgcccaggctggtctcaaactcttagcctcaagtgatcctcccacctcggcctcccaaaatgctgggattacaggtgtgagctactgtgcccagccaagagtcaagttctaaccctggccttggatggcacatagggccttctgggtgggtaaaatgtgcccactaggccctgccagagtgttggctctcaggccatctc

SEQ ID NO: 107400 - DNA, 493 bp, Homo sapiens
taggccagggtcaaatttattttaacctagcctttccacttttgtttcttcaactacaattttacttgaaaggttcacctcacattcttgactaggtttctcggctacagaaaaacatgaaagagaattctatgcccattaaaaaggcaaaatgaaaatctgtgaactaaatgggataaaactggttcctgtaagaattatgaccacctttaccgaaatttttaaaactcattgttttactaacaggatgctcctggaattttaaaggtaaagtctgaacaacagtagagtaacctcaaattccaagcacaagtgaagacaaactttgagtaacagctacaaaaaggtagtactttaatccaaagttcagttcaaaataaacacagaggatagtagagggtctagaaagagaaccggaataaggaggtaccagtaggaagaggctataaagggagtgacgctgtggtggggcggtatggaggacaggtgagaa

SEQ ID NO: 107401 - DNA, 452 bp, Homo sapiens
ggtgcatactttacagttgagtttgatagcatagcaaggcttgacagataatgataactagctatctatgtgcctagggtttctcatacatcgcatcatgaatttttttacaaccttgtgtccagtgtattgatcagaaaggtcacagagacaagaagtgccccagcaggaattcagacccatctctgtttggcttcataatttatgcaaatcgatcccagacagaattctacttagaaatgcctcaagataccagttggaaattatctttcatttctgaaactggaaattaaaaaattatttaaacaatgcataatcattgtaaaaatatgtaggcattgggatatacagtataaataaaagaaaaatatcctttgtagagatcctttgtagacatagccaccattcatatttcgatgtgtgtcctttttgacctttttcattgtgtggct

SEQ ID NO: 107402 - DNA, 445 bp, Homo sapiens
ggccaccagagggttctcggggctccttggtcctggactgtggaactgggggcagctggttcctgggggctctgaagtcagtgtctccctcactgctcactgccatggtgtctctgcctctctctgcttctctgtgtccctcatcttcctcccacttcattctgactggcaagccctgtcctgcacagcttcttcccccacccctaggccttccccagacactccctctaactaggctggctgttctattcccttcccgctaacactgtggcctggcccacctcccaggaaataggaaaggtgcagaaatcacctggagttgccactcctgccaggcttcatctcgagccaatgtccccaggtcactaagagaatgagcttccactgtattcccatcaagggctcttcccctttgtgaggctgacctgtggacaagaccatggga

SEQ ID NO: 107403 - DNA, 1175 bp, Homo sapiens
tttttttttcatgtcacatgggtaatgtaccaacgacatgacaagatttaagggaggcacatctcacagacaagcatgaaaacccaatcatcatgcttatgaactaaaaaggaaactggattcttacaatcagaaacaggaatatcaaccaaattgtggtaccctatgagccaggagccacagaccatgcccaccttccactccgcctcttttaactttattatacaaaaatagctgtatccctccccaggatacaggcaagtcactacagccttgagaagccagcaggaagaagaattaaaccagatctccctaagggtgaagtagagctgccttcaaagataggaagttcctgcctctggagttgtttgtttattatggtacaagaaatcgagcacaattgggtcagaagaacagaagacccttccagcgccaattttctgggaggtggtccaaaggaagtcagtggggccagctctctccctcagacagctaacaggagcaaggcttggtcagccttcctgaagctctgcaagtccaaggcttctgagctatttattctatacttactttgaaaacacaaaattgctccaacaggatggatatgttacggaacaattaggcataataggatgtgcatttctgtctactgagaaacaccaggtagaaaactgcaccaagctgaattgagcttcgtggtaatacacaaaaaatgcacacagctcagctcaacaagtgcactgagtcacaccaaacacatttgatgttacaactttccatccaattccagataaccttcctcccactgcttctcaactgctcaaaagcctaactctccaaacccatttccacaaggtaatttgaagactttttcaaataaaatgccaaatttaccatagtagttatgtatttcttaaccatttaacatttataaaactatatcatttttattcagttccttttttcagatgtgtcactgacaaagttttagaatattgtgcccttaaccaaattttccccgtgagacctgtggtttcattgtgcagttctgcttaatgtggtaatttttagaatgcgtatgtcatgttgtattgtagcagaactatttccagggctctagtgtagagtatttacattcattcttaaaaattacactaaatgtccaaaaggaaaat

SEQ ID NO: 107404 - DNA, 279 bp, Homo sapiens
gggatcggtgtcttcactccatttcagagcagtttaccagaaagcctcttgctacccatcttggcagggttttttagaccattcaaactcaaggttcaaaataggcatttgccaggcccattcacagatctgagatggccaagtcactgaatgtcaaggttggatagactcaggtcaccttctcctgccacctctgcagtgccctgcactccccgcctctccactgtttcatcgggtggctgtgctttcctctgcagtgctgagtctacacggagccat

SEQ ID NO: 107405 - DNA, 464 bp, Homo sapiens
gtggtaagaggctgggaacaagatgaagcagacaaggtgaaaggggatgaaacaggaggaaaagagagagaaggagagggcagtctgctgcagtcccagtgccctggggatcagtaactttgcatcctggccctagccccacttattactgcctgtgtgacgttgggccagtcatctgtgctctgggccagctcccttagctatagaatgaggtgcggagagaagctgtgatctctacagccccctcttcctcaagtggcatgaacactctctttttctggaaggtcccttaccaactgctggcaaccactgcgaagagcagtgggcaggtgggtgcagatggcagtggtgctgatgaggggttgggggtgctggcacctcaggataactcaaaagcggtgcaggctgaagcccttcctccctccttccttctacctcctgcctgctgagccccccaggaccca

SEQ ID NO: 107406 - DNA, 355 bp, Homo sapiens
gtcccatgctccttatgagaatctaatgcctgagaatctgaggcggaacagtttcatcccaaaaccatctcccccactccagtccatggaaaaattgtcttccatgaaaccggtcctggtgccaacaaggttagggaccgctggtctaaaggacactgggcgatatacaaattgctgtacaaatgacggatggacttcagctttctcatctctaaaacaaggttgttacgaggattccctgaggcagtgcatgcaaaatgcttagaactgtgcctggcacatagtagaagcctggtaagtgtcagctagtctgattagatgaagtgcagcagggatacagaagagagagggcttg

SEQ ID NO: 107407 - DNA, 523 bp, Homo sapiens
tagatgcaaaatctcacataaaaaccatttaagaaaatctggggacatggaaattgtttttttccctttaacaagatggtaccactaatgtattcttatttttttgcccagagagtagcaatttctaaattgttagacatggttcttctttggtttcacataacccattccttcatggtacttaaagttagtaaatggttgaaatacttccttgagaagtagaaatgaggaagcatgaagagattaaatgagtcacttaaagccactgtaaggaagttttccttcctttttattggtttctgcctttggtgttctgctgcttaccctccctccttcctacctgccttgtgctggaaagggccgggatttgggtatgcccttctcagctgtgtgacttcgaacaagctatttgacgtctcaaggtcttacatttctcatctgtaaaatctaagatccttctcttcaaatggctcccaggtcacccctgctgcagaccaggaatatggctaacattttgggattt

SEQ ID NO: 107408 - DNA, 484 bp, Homo sapiens
tagctgggagtcactggagcttttagagcagggttgtggcataagcagaactgtaataagcctaatttggcaggagcaagtcccatgcgtgacaagagtggagatgaaaggcaaggtgattagacagagggtcattttaatcatctaagcatgaggtgtgagggttttcaccacacagtacagtaggttggcctgaagagacacacgagcgagtaattacagaggaaaatctaacaggacctcaaaaccggtaggacatgggagcaggagagaaggaggggtcaaaggtgatggtgcggtttcaagcctggctgaccacaggaaaggtgatatacttagccaaaataaagaacacagtggtaaccagagttcaggacatgtgagtttggagctcaagagagtcggggctcttattagaatcagaatatttgtcatcagttagttggtttagaaacataaaaactctctataaaaaataaaatct

SEQ ID NO: 107409 - DNA, 1480 bp, Homo sapiens
gccagacagctaggtgtcattcagggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcc

SEQ ID NO: 107410 - DNA, 566 bp, Homo sapiens
cccccatccgcatcctcctcctcctgtcccctcttcctctctgtccctcaccaagccatcccctctttgcctctccccatccctcgctggcctgctcctgctccccttctcccatcctcccctcccccgtctctgcccagccagccccctcccgactccccagtttcatcggactccctggccccatcccgtccccgccctggcccctttgtgccccttctcatcgttttctccctccttcccgggcttggcgtcccttctccacccctaactccttccactcggcctccctgccccttcacggcccgcctgcctccctgcccaagtcctgagccaccatgctgaccccgatggtggccgggggggtggtgttccccggactcttcctcctctccaagaacacgctccagcggctgccccagctacgctgggaggaggccgacgcagtcattgtctcagccaggctggtgtcctctgtccaggccatcatggcctccactgccggctacatcgctgccgcccggcacgctgctcaccaacaacaaacacagccctgcagcacgaac

SEQ ID NO: 107411 - DNA, 2089 bp, Homo sapiens
cggggctttctcgcggggagcgaaggggaagagcgaatcccgccgccgcccgcctgggtcggatcctcatcagatgccggacgttggaggaggcaccgggttctggggcgccacaggaggattgaacccccaggctacacccaccacttggatgtatctccggccaagccactgagcatctgcaaaagggagaaacgcctgccgctcagggatattggcacccggtggagaggatgagtgaaacagcctgtgggcggcagaacctggaagaacagagaacgacaagcctgtgcagccttggactgttttgctctcaacaagaagaaatcgacaaggaaaggaagaaatgtaggagagagtccagattccagtgagactcgggcctgactctaaccagctcatggcctgtaaactttcctcccttccacattttcttgtctaggttctgggtgctgaggagaaacatcaacctccctttctgtcttccaacctgtccctctgaggcaggcatgaccctgctgttcgcagtgggttgcgtcttcttcccgttgtgcttcactgccctgcgctggggcttgcagaaccacaccaacctgcagatggagagacaagaggctgtcctggtagcatccaagctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcc

SEQ ID NO: 107412 - DNA, 2040 bp, Homo sapiens
cccccatccgcatcctcctcctcctgtcccctcttcctctctgtccctcaccaagccatcccctctttgcctctccccatccctcgctggcctgctcctgctccccttctcccatcctcccctcccccgtctctgcccagccagccccctcccgactccccagtttcatcggactccctggccccatcccgtccccgccctggcccctttgtgccccttctcatcgttttctccctccttcccgggcttggcgtcccttctccacccctaactccttccactcggcctccctgccccttcacggcccgcctgcctccctgcccaagtcctgagccaccatgctgaccccgatggtggccgggggggtggtgttccccggactcttcctcctctccaagaacacgctccagcggctgccccagctacgctgggaggaggccgacgcagtcattgtctcagccaggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgccaccaaggcccttgccaccaagttctttggggctgggaagggaggaggtggggggcttgggccatgggaaacagaggggacaggatccccagctgctcgctgggcagtcagggaggaggaaag

SEQ ID NO: 107413 - DNA, 1918 bp, Homo sapiens
cccccatccgcatcctcctcctcctgtcccctcttcctctctgtccctcaccaagccatcccctctttgcctctccccatccctcgctggcctgctcctgctccccttctcccatcctcccctcccccgtctctgcccagccagccccctcccgactccccagtttcatcggactccctggccccatcccgtccccgccctggcccctttgtgccccttctcatcgttttctccctccttcccgggcttggcgtcccttctccacccctaactccttccactcggcctccctgccccttcacggcccgcctgcctccctgcccaagtcctgagccaccatgctgaccccgatggtggccgggggggtggtgttccccggactcttcctcctctccaagaacacgctccagcggctgccccagctacgctgggaggaggccgacgcagtcattgtctcagccaggctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcc

SEQ ID NO: 107414 - DNA, 2347 bp, Homo sapiens
cggggctttctcgcggggagcgaaggggaagagcgaatcccgccgccgcccgcctgggtcggatcctcatcagatgccggacgttggaggaggcaccgggttctggggcgccacaggaggattgaacccccaggctacacccaccacttggatgtatctccggccaagccactgagcatctgcaaaagggagaaacgcctgccgctcagggatattggcacccggtggagaggatgagtgaaacagcctgtgggcggcagaacctggaagaacagagaacgacaagcctgtgcagccttggactgttttgctctcaacaagaagaaatcgacaaggaaaggaagaaatgtaggagagagtccagattccagtgagactcgggcctgactctaaccagctcatggcctgtaaactttcctcccttccacattttcttgtctaggttctgggtgctgaggagaaacatcaacctccctttctgtcttccaacctgtccctctgaggcaggcatgaccctgctgttcgcagtgggttgcgtcttcttcccgttgtgcttcactgccctgcgctggggcttgcagaaccacaccaacctgcagatggagagacaagaggctgtcctggtagcatccaagctggtgtcctctgtccaggccatcatggcctccactgccggctacatcgtctccacctcctgcaagcacatcattgatgaccaacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgtggcgacagggtaagggagacttctttctgggttgcatgttgatggcagaggtcagcacgcccttcgtctgccttggcaagatcctcatccaggtgagtgagcatgggagggtgcaggagcccaatggggaggtcacaggaaggggagggaccttcaaggttgctgccaagggctctagccccttcgtcatccccccctcaccccgtgcattttgagcacctggtgcttgtgtcctggcaaagtgtctggtttgggaggagctgcctgctagggtcgcagggaggcagggagagggccaaggggggccgagcccttctgctgccgtggccactgtgtctgtgtctcctcagtacaagcagcagcacacactgctgcacaaggtgaacggggccctgatgctgctcagcttcctctgctgccgggtgctgctctttccctacctgtactgggcctacgggcgccatgccggcctgcccctgctggccgtgcccctggccatccctgcccacgtcaacctgggcgctgcgctgctcctggcccctcagctctactggttcttcctcatctgccgtggggcctgccgcctcttctggccccgctcccggccgcccccggcctgccaggcccaggactgaggccgggggccgggaccctccccctccccacccccacccccgtggagacagggctctggggctgatggctggggttgggagccagggtcctcttgcccggacaaccccaggactgacgatgaccccgaaagggaagaggccccatctctcggggactgagggggtggagagaggggacctcttccccctactctgcccccttcctgcacacccttgcgctggaggaggggagggggcaccgcctcccacccactgagggcaggagggcttgtggggagggacaccaacagggtttcaaggggaccaggagtcagaatgtggggagacgcctctgccaaggccatcccagcccctatgctgccatcccccagggctccccatcacccgagaggagaggacgccccaactaacccccgctggccctcgggcctcccgagtggccggctgcaaccacggctcctctccagggtaggccagcttgaggaatcttatttattttatttatttacccaaatttgaactagtctgttgggttgggggaaggaggtggctgctacccccaagccttcccagtgctgacaaccccgggggcaggcgagggcgcccagtccctcaccatcggctgcacatcgcgccctcgggccctgccatgtccctggtgctactgacctctcaaggcttcctccaatctggggtcgggggaccctgggaggtgctttacagaccgctaataaaagacgatctgcgtgaacgcc

SEQ ID NO: 107415 - DNA, 812 bp, Homo sapiens
tctgaccccaatcactggtgtcccctttcctccttgctcccccaccccgtctctctgcccaacagacactggctgtcctctgcctacacgcaatttgctgtgccctacttcatctacgacatctacgccatgttcctctgtcactggcacaagcaccaggtcaaagggcatggaggggacgacggagcggccagagccccgggcagcacgtgggccatagcgcgtggctacctgcacaaggagttcctcatggtgctccaccatgccgccatggtgctggtgtgcttcccactctcagtggtgagtcccggggagctgggcgggcggggtgcgggtggcctgctccttggtcctgctggtgctggcaggagcctgggaagccccgggtctgcgtactgacaaccaagcagacccagcgtattcccagggaaagctgtggacaggcagggttcactgagcaccagcccagggcaccagggtgtgggggcagcctggccctgggctggacgatgcccggctgtggctctttggatttgtggttgcacgtctctgagcctcagtttcctcacctgttacataagggacacagtctttctgcaggaccgtgagagggatgcagccaagtcatgcacctgctcctgcacccaggtgttctttctcttttttttctttccaagacggagtctctctctgtcactcaggctggagtgcagtggtgtgatctcggctcactgaaacctccgcctcctgagttcaagtgattctcccatctcagcctccccagtagctgggattacaggtgcccaccaaca

SEQ ID NO: 107416 - DNA, 566 bp, Homo sapiens
taatgtcttcgaaagtattgactttaacaagtactttgtgatgcatttattatttcatttgttattatttatgtatttgatttatttctttgtgaggtaggatagaatctcagtcagatttttgctgttaggataccacagactggataactacaaagaagggaagtctgtttaactcgcaattctagaggctggcgcatctaagagcatgacactggcaactggcgaggatcatctcatggtggaaggtggaagggagtacatgagatagagagaagcaccaggggctggactcgctttgtaacaaccaacccttgagataactaacccgctcctgcaataatgacaattaatccactcatgagggttccaccctcatgactgagtcacatataattaggccccacctcctaatattattcactggagtttaagcttctaacacgtgaacttttgggggatacattcaaaccatagcagatgatgagcaaaagtacatacgatcccttatctattgagcttacagcttagaggagaacatacatttcttaaaatgtttcttaaat

SEQ ID NO: 107417 - DNA, 744 bp, Homo sapiens
gtaaagaagaataatgaatgcaaaaaaggaacctactgagctatcaaaggacaaacttgtaagattctgaaacttgtaagattctgctttttccagaaactactctaagaggaattgaaaatggtaagagaggcttccgaaaaaaggatattagctcaactatacaagtgagtgaaaaaaaaacaaattatatatacagttgacagtaatgcaaaagaaatgaacagacccaagaaatagtagcaggaagctgaatctgtgataaaggtgtagcatctttgacacttctgtggatttagattctaccattcatgctatgtgtttagaattacagcctgtgatatcctgtgagaggtacaatgtccttccgtgggttttagtggctctttagaatgggtaggagtaagacacgtgagcatcccagagaggcaaatgctgtattttcattccattgtcatttatcaaaatgctttggccaaggctgctgaaaggaacaactccatgtagacacatgggaaaataattaggaagtaaatgtaggaataggtgctaattggaacagtcttccctatttccaatcagtaaaagaccttgggaagattttggaaaggtctttgaagctatcaactagatactctagtattagtaaaggagtcagttctaagttaaggaatgactatggttggttgagcactcattatatccttctgaaatattccctatagttctgatctgtagcctaca

SEQ ID NO: 107418 - DNA, 345 bp, Homo sapiens
ggacaagcattctggaggggagcctgacactccttagttcaattagatgtaaataaaactctgaacagaactgctggtttctggcttctcagcacttctgttcctgagtttttatccaaaagaaattcttatataggtccaaaagggaatatatacaacaatgttcattgcagcatttctggtggtgatggagaattggcacaagcctagttgtccattgctgggaaagtggggagataaaatgcggtgttggagcaacatgaagtttaacgcagattgacctcatctctacaaaaaaataaaatattagccaggcacagtggcatgcgcctgtggtcccaattg

SEQ ID NO: 107419 - DNA, 618 bp, Homo sapiens
  misc_feature (612)..(613): n is a, c, g, or t
  misc_feature (617)..(617): n is a, c, g, or t
gtttcctaagacataagtagatggattttgttcaaaagccttatcccaagggttgacatcagttctaatgtgtctcactatggtttctcccaggagtcttctcaaaacctcttggccccacaatctcagctgttagccccaaatgccagtatctggagattctttgccaggttaacccctactttcccctttcaactcacaggggccctagggacacatgtatttgcctgaaatctctctcttttcttgtgtttgctaattttctggcatatcttttgcctatcttgattttttgtatttccaaaatgtgtacatagttttaaaattttaggatacaaatgccattcctgggtaactaaaatggtctttgctacaattattattccatgtgtgagtaccttgtgcatgcttggacattatcagcaaagccatgggatttgattctaatgtttattttaattcagctggttcacattatataataaaatctgactaattctgaataatggaagttaagactactgtgatttcctgaaaaatgagaatcattgactaattttcaacataattaaattgttttcctttcaaattccatgtgtatcataaacaaannaaana

SEQ ID NO: 107420 - DNA, 414 bp, Homo sapiens
  misc_feature (10)..(10): n is a, c, g, or t
agaggatccncgcacacacagacacaaacacataccacacagactcacacttgtgcacacaactacacattctcacacatattgtgtgcacaagtgtgtgggtgtcagagagtgtgtgtgagtctggtgtgtgcatgcatgtgactccatgtggtgtgtgcatgcatgcgtgggtgtgccatgggtggagtgtgtatgcaggtgtatgaatatgtccatgtgtgtgagggtgagtctgtggtgcatttgtgcatgaatgtgcacgtgtgtgttcatctgtgttcgagtgcgtatatgcatgtgcatgtgtgttcatgtgcgtccatgtgttggtgtgtgcccatgtgtctgcgtgcatgtgtgttcatgtatgtcagggtttctctctcccctcccttggtcttaattcttaca

SEQ ID NO: 107421 - DNA, 550 bp, Homo sapiens
gaaggtatgatccatggatcaggaaaccagccttccctagacatggaatctgctggcaccttgattttgaacttcccagactccagaactactcctgcccctgccacgagaacacaccctttccagtttgctggagaaatataagagaagtccagtgaaagagagctgagtttccccaatgatgccatcaagatgaactaactacagttaaccagccagctgatagcagatgcatgagtgagcccagctgagagcaggttgtgcaagcatggcacgtgcatctgtttggcttgtggtgaggcctcaggaagcttacagtcatggtggaaggcaaagagggagccagtacatcacgtgaactcgtagagtgagaactcattcactaccatgaagacaacaccaagccattcctgagtgcctacaatagttcctggtatgtagaaggtatacaataaatattggcggagtgaaggaacaaatgggatttgcttgattctgctgcagaagactaagaaaaagacataaatgaataaataactagtagaatgtt

SEQ ID NO: 107422 - DNA, 337 bp, Homo sapiens
tgacctgaacatctcccactaggcccacctccaacactgggggtcaaacttcaacatgaaatttggaggggacaaacatccacgtcatatcagatatcattatttaacctaccatatccttggaattaggggttgatgtgttactgcagcatagtttaatgtatgctgaggaatatggaagccatagtaagttaatactaaaatctcactggacattaactatagaagtatgcccaaggtaactatttagtagacataatcagcctcaactttttgttgtcttcatgaggttgcaaattatagaacttgcttatgaaagttaatacaaaatgcacaa

SEQ ID NO: 107423 - DNA, 398 bp, Homo sapiens
ctgctttcttttgtagactcctgcccctgccacgagaacacaccctttccagtttgctggagaaatataagagaagtccagtgaaagagagctgagtttccccaatgatgccatcaagatgaactaactacagttaaccagccagctgatagcagatgcatgagtgagcccagctgagagcaggtgagcatggcccagagcagcagagctgctgagccagtccctgagttgaaacaaaataataagtggttatcttcatccattaagcttaatttgttgtacagcaatagtgtatcgatacaggatcatttgttccagaattcccatattagagatgagaatactgaggctggggatctacattttccccaacttaacagagctaccaaactccccag

SEQ ID NO: 107424 - DNA, 180 bp, Homo sapiens
aaggaaggcagtcaggcaggcagggaagggagggagggagggagagaaggaaaggaaggatcaattaccttatcttccacttcaggaaacatggaaaaatagagcaaacaaaagcagagggaataaaatactgaaaactagagtacaaataaatgaaatagatactagaaagcaatagag

SEQ ID NO: 107425 - DNA, 636 bp, Homo sapiens
  misc_feature (516)..(516): n is a, c, g, or t
gaattgtctgtttgcttttagtacctacattttcgttatgaatctaggtgtgtaaagagtgagccaccacgccctgccaaaaatgtgcatttctagcaggttcccaggtgacgctgctggccacaggggctgacgctgcgggaagccctgacctagtgcacaacccattgggctcttcactgtcagtgtagaggcataggtccaaaatatgtttccccagtcaaaaacatgtaaggtttgcaccaggagtggaaggaaacaaacaaacataaaccaaagcaaagacacttaagggctgggtactcatgcctgtaaacccaacactttgggagtttgaggcaggaggctcatttgaggccaggagtttgagaccagcctggggaacatagtgagaccctgttgcaacaaaaaccagaaaaacaacaaaaagaagacattggaaaatggctggagctgattctaggtgaataaacaaccctcgacttaaaaaaaacaaccaccgacgcacctccccgngcttacgttccatggatggcggactttgcttaatagcgccttagagttatttcctctgggggggggcccgggacccctattccccctttagggggggtggtataacaattaattggcccg

SEQ ID NO: 107426 - DNA, 502 bp, Homo sapiens
gaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaac

SEQ ID NO: 107427 - DNA, 323 bp, Homo sapiens
aaattgcaacgtcatgacttgtggcgttattaaaacttcctgtattcctggttggctggatataatcttgaacaaaaggcatgcacttaaacaggaaaggtgaaaggcggaatgcaggttttcagctaaggagcttcccttttaaagaattgatgaagtgtcattattgggggtgggtgtgaaaggtgttagctaggaaaattaactttgcacttgcattgatattaagaaattattttcggacgggcgcggtggctcacgcctgtaatcccagcactttgggaggccgaggcgggcggatcacctgaggtcaggagttcgag

SEQ ID NO: 107428 - DNA, 784 bp, Homo sapiens
agtgatgtgctgcagatgtataggtcagtttgtcaggaaaagatacccaaggtcaggaattgaatttctcaggagtttctaacaaaatgcctgcctgcctgtgaatacaaaaggagactgggaattgcccccaactggatacagtcaattcctactactttgaaataacatgtagtatagctatatataagaatacataagctcacacagagaaaaagcatggaaagagtgtcatctagaaatgataggtatgtaagaatattataagctttaaggcactacacagaggttttagtaatggaacagttaactaccatctatggtgcttcaattcatacctatgttacaacctcatccagcagggctcattctagtacaattaaataacggttgtgcaaacactggggtctgtctggggatagggtgcggggagggagagtattagaaaggatggctaatgcatgctgggcttaatacctaggtgatgggttgacaggtgcagtaaaccactatggcacacatttacctatgcaacaaacctgcacatcctgcacatgtaccccatacctaaaaagaataattttaaaaaagatttgagagaaaaaataataataatggttgtgaaaacactttgaaagtataatcataccaaacaaatgtgagattgcaccattttactattattttcttaaacgactttcctttaactgcatactttcctattttctcttcctgtatgtgttatttaactagtcaatagtatcttgagttaattttgaagtta

SEQ ID NO: 107429 - DNA, 456 bp, Homo sapiens
atgtgatggtcatggcctggcatttgtactcagctatggtagcagaatatgcttaaattgataagattagataaatagcattcttcagatgttctggatgacagcatatttaatgtaattgcatttgtctgccagtttctatgtgttagagcacaaaagattttgaaccatgcataattttgatagagaaattcaatccactttcttctataatataccacaaattataaattttcattgcaactattcaatcgcttgagaaaagaatgcatttcaaatcaggttccatgccaaatacctcatttatggagctatgctgcttaaaattggacaaattgattaccttactgaatattgaaaatattagttggaagcattaaaaccatctttattagctctagactctagtaatacatatacttgtgtaataaatattaagagctactaatataccag

SEQ ID NO: 107430 - DNA, 378 bp, Homo sapiens
tcctctagttccttctagaatcatccttgaaaaacattcatgaaggaggaagaaatgatgggtatgtttcccaatacttttttgtctgatctgttctgtttcgttctttttttgtgtttcagcatctaacacagaatctgcttgataaaagacacccagtaaatatggatagaaaaaatgtgtttgaggccgggcatggtgactcacgcctataatcccagcactttgggaggccaaggcgggcagattgcttgaggtcaggagttcgagaccagcctgcccaacatagtgaaaccccatctctactaaaaatacaaaaattagtcaggtatagtggctcacgcctgtagtcctagctactcaggaggttgaggcagg

SEQ ID NO: 107431 - DNA, 428 bp, Homo sapiens
ctggaaagagaatagaattaaagagaagaatcatctatgtatgaagcctggtctaactgataacgcagtcagattgccatttttaagatggaaaaaggggaacatgcttgccttgagcagaaaagtttttggtggggctggagctcctaaatattattttggtcatttgcccaaaaactgaagtacaccaccaatgtcccaattatgaagttgaatacagaattataaaaaaaaattgttgaaagtcaataagaataaatcttagaatttggactcctgccacatggcagaaaaaaagcatgatgttttaagacaacctggcctttgtccaacatgatgtttaccagattgctgacattttctagcataacaatactattcatcattgggataaccaaaagaagggaaataaaaaaaaaaagaagtct

SEQ ID NO: 107432 - DNA, 698 bp, Homo sapiens
tctgacacattccacccatacctgaaactacaatgaccatcagcccctgggccagaggatgggcttctccctgggcattctgggagtcatagggtcctttaatccaaggattagctctggcctttgaggacatgaacatccaagggcccaggctctactctcgatgccaacttcatttactctagtcttccaagcatagggattcttggaatcagcctcaaagtgaggctggcgggcttgcccgaggaattctaggagttgtagttctctagtgtgatattgctggactcagctctcagatgctgccctggatgctcatgaatccccagcctgacctggttttgacccccttctaggttttaagaggctcaagaagcttagtttccaggctgggcacggtggctcatgcctgtaatcccagcactttgggaggccgatgggggaagatcacgtgaggccaggagttcaagatggccaaacctcgtctttactaaacatacaaaaaaattagctgggtgtggtggtgggcacctgtaatcccaaatcccagctacttgggaggctgagacaggagaattgcttgaacctgggaggcgggaattgcagtgagctgagattgcatcacggcactccagcctgggccacagagtgagacactgtctcaaaaaaaaaaagaaaaagaaaaaaaaaaaaagaag

SEQ ID NO: 107433 - DNA, 190 bp, Homo sapiens
acaaagggatttttgctaggatgaggggaagatgaacacgtctgcagacttaaggtcaagagaaggagaaaattttggatattcaattactgaacaccggtaacatgaaaacaattatctaacaagtttggttgaatacaggaaatttcctccaataaagaaagattgtatcagttaagtctaatatata

SEQ ID NO: 107434 - DNA, 342 bp, Homo sapiens
tcagtccagctgtttcttaactccagcctcacactatacagatgcattctctccagagccctttgcccccaagtctagactttagttctgacttaattcttcaacacttagtaagaacaggcagaactaaatgtttagcagaatcttggtgaggaattgagaataatcagaaaacaaaacatggataaaggaaaaagaaagaaacttcaactgaatactaggtattatggctcctaataagcccccatgaggaaaccctctggtccctctttccttagactcccgtatccttgcctgttgccatattacagggggccccctaccatgaagggcctctggcca

SEQ ID NO: 107435 - DNA, 551 bp, Homo sapiens
caatactgactcttgagtcatttgctcattctctcaataaacttactgaatttagtcatgccattttggaagacaccaaagaaatatagtaatgatctataagactggtgggaacgggtgcttggattttactcaggaagacctgggaacaagattgtattcccttttaattggaatcattaaaatatatccaggcttatgcaactgcagctcattatagggagatgttaagtaattctctaattatatgtattacactgtaggcagaagatcctcagacaagtgacttatctcacatgtcaaggggcagagctaaaagcaggacttgacttcctgacttgaataactgttctgaaccagctgcctagcaaccatggcctccgttcaggagcagctaccatgtgaggagcgtcggtgcccggctgctccactaaactgtgaatttctcaagggcagaaacagggtcctgttcctctgcatttcccccagggccttgtctggcatcagacacacagaagagagatcttcagtaaggagtcagctttacagtt

SEQ ID NO: 107436 - DNA, 629 bp, Homo sapiens
ttaaaatcagcttttcaagttccgtaagaacacttgacaggatattaaggttctagttaggtatcccttatctgaaatgcttaggaccagaagtatttttggatttgggatatttttttcagaatttggaacatttgcattatatcagttaagtatcccaaaatctgaaatctgaaatgcttcaatgaatatatattttttagcatattgttaatgcttaacaagtttcagattttggagcatttttggattttggcttttcagatttgggatgctcaacttataatcacattggttttatagatttatagattaattttggagaagaactgatatcctgaaggtaatttattatctatgagcatgacatttttctgtatttgcttagatcttctttaatctttttttcttctttaatcttttaatgacattttcttttcttcataaaggtcttgcatacctttgttgagagaattataattctttataatttaattgaatttcttatttttggttattataaattgtattttgaaatgatctttctaacattattgctggtatgtgcatgtgcatttggcttgtgcatagtaatttgataacagaaaaaaactttctaaactcttatt

SEQ ID NO: 107437 - DNA, 1214 bp, Homo sapiens
gggaacctgggaactgaagatctttctgcccaaaacaagctggtgtgagaaagggcacggttcctagacatgtgaacaaaaacaagccactgaggggaactctggacagctttctttgagaggaaactttgccaaattcctagattcaggaaaagccaatgaataaaagtttgactctcaacaagcttatatcatagggacatgtttttgaaaagttgtattgggaccagaggaaatgttttactacctcactgattctcagaatagaagaggtttgttttaaagtatttatttgactagaaaggcatttttacatgcttgaatacactatacatttgcaaagaaagttccagtactgcaaagtgattctagatacagtgtcttatttaatagcacatatttaatgttcttttgttgctcatcattatacatcctgtgtttgggttgtgccagcccttattgcagagtaaaattagtcaactcttagtcaccagctgggtcacactggtggctgggaaagaccaagaagaggcagaggaagaggtggcaccgatgataaaaatccattcaagaatttagctgtgacacatctacagcaggttcaaatctctcagctgtaagacaaactggatactttataaggactgtggcctattatgcaccaaaatgccttactgaaattgtctggatgagctgcctgctgggtccagtgatacattagtaaacgaagaagttgaaatagaaggctaacatatgctttggatcgcttggcagtgtgacaccaatatggcatcaagccttactatgagtccaaggacttaatgactaaataaaagtaaaaatgaacaaaaaaaaaaagtgaatgcttctagatttccttcaaacagcctcttttatgacttctcttctttttgttccttctactttatgccttacttctcttctcacaccagggcaggcagtatatagtctagtaattatgagcacatgcccagattgggctcaaatccctggctagcactaccctgtgaccctaggcaagttccttaacctctgtgcctcaatttcctcatctgtaaaatggaagttaatatgtatctcatagagtagatgtaggattaaacaaactagtacaaagtacatgtgaaacatctagagccccatctgttatgtaataagtgctcaataaataataaatgccattatactgatta

SEQ ID NO: 107438 - DNA, 393 bp, Homo sapiens
actccctcacaagattcaggtttctattcaaaaggctctcatggagaaataaacttgcttgaccattgtcttggtttggtttcttccaaaaccaactctaaaaccagaattgggtagaaagagtctatttggaaggcaatccctgaaagcagagtaaggaaataagaagatgaggcaaggaagagaagaaagccaattaagagtgtgctgataggtgggtcactactgtgggcacctgagacttcacaccactggagacacttaagaactatcaccagctccatctctcactagttgaagagattgcttctggggacattagttcccagtctgcccatgtgttgtcagagctggtacttgaggcagagaacataataggctcccaatgaacat

SEQ ID NO: 107439 - DNA, 437 bp, Homo sapiens
ggaacctggacaatatctattcactctttaagattcaccatttgttgcctccagtttcaaagtttttcccatttctccaagtagagttagtcattctcccttctgcccatgtgtatctctgttacgtgccatatattatatgccacatgatattaaatatgtacctattttattgcctttaagatgtgaactactctaaaagagtaactactggttccttatctctgcatgccagcacccatcacagcatctggcacttagtaatttatcaataaaagaagagagtaatttatcaataaaagtaatttatcaataaaagaacaaaggaaggagggaggtagaagagagagaaaaagaaacttgagtgcatcttccactgggagagacttctgtttcctcaactccagattacatgagaagaggaggtgtataaattt

SEQ ID NO: 107440 - DNA, 420 bp, Homo sapiens
tgagatggagtcttgttctatcacccaggctggagtgcagtggtgcaatcttggtacactgtagcttctgcctcccaggttccagtgattctcctgcctcagcctcctgagtagctgggattatagttgtgcaccaccaagcccggctaatttttgtatttttagtaaagacggggtttcactgtgttggtcagactggtctcgaactcctgacctcaggtgatccacctgcctcagcctcccaaaatgctgggattacagacctgagccatcgtgccctgccaataacaaagttttgatgagcgtttttctctctctccttctagtgaatccagttctggaggttcagggtcataatgttgggatcctgcccagctctctccataatcctctgtgtgtattatttggaaatgcctcttt

SEQ ID NO: 107441 - DNA, 398 bp, Homo sapiens
aaaaaatgctatgggtcccaaattataacaaaggataccttttaattttaattccaatattgttttcaataatatttcaacatgtttcctgttgtgccctggtattcttaggcagccagttgtaaaaggcttctttgatttggcagtaaagagctcataaaggaatgagcactaagttattcattgcccattagcacaaattgcaggttaggtatcagtcaagtgaggcaatggataacatttcttgtatatgtctaagaaacttgtgaaacagaatttcctggcagattaaatttaatttaaccatactgaataaagaaaaatttcagggactttgtaaatggatttcttagaaggatttaaaagtggcttaagttttgcagttgagtctttttaaa

SEQ ID NO: 107442 - DNA, 537 bp, Homo sapiens
acccttaattttgaagctcttcacaaattgtgagatccaaataatgactcaggaatgacatatgttaatgaagaagcaggaaagacccaggcagaaaggtaaggtgcatgtatgtatatatggaaatcttgtcagtcacagatccaggctaatatgtgtggggaaagaataaaacatatctgtacaatatgactgactgaccactcttagaagttttcaagaaaaaaatccttcatgaagtcacaatttaatttctcattaaaaaaacagaataaatataacagtttattaatgtaatcagactttaaactttctaaagaaaaaaatagtcaccttacaacaaaagaaaccttcatgacagatttaatcatgttgtgactaaatgctgcattttattattgattaagaggttttgaccatgaccattcattagattgcacttctctttacatggaaacaatgaacgtctcaagtacatgtgtgacttcttacatttgtgttttctttgaaatctcatttcgcctttaactttacatt

SEQ ID NO: 107443 - DNA, 762 bp, Homo sapiens
gaggactcctctcctgggctctgcaggtggcagctttggtcacactgacagtcctaagaatgggtgagacttaacagtcggtgtccctcctcaagtggggttcacgactgatcaggcaagtttgcagcagctgatgggtgagatgtcatcgaggggcattcctctttgggtctggagttttggctgtcaagctcctgttcttccagccatccatctccatgttacgattgtcctgggaccagagagacttgagaaggtggcatgaggctgtagaaaatgtgtcttcctatacacagagatatgatgtctgctttgagtctatacctgtcgagttgtgtcttggacttacggtctgccaaggtggtaaatgttagctgttgatgggatcatcactgaagtggaaggctccacaaggtttacaaaatgtgttaagaagaatgttgatggtggtgtgtggtgcctaacatcttaatctcagcatttggtgaggcagaagtgggaggatcacatgaggccagttcaagaccagtctgggcaacatagcaagacccccatctctacaaaaaaattagaatgttatgaagatactgaaaagaagaacaggagaatgtagtgggtaaaggtctgggccctggaacagactgggtgcagatcttgggctgcccatcacactggtggagagcaagttatctattactatcttaggctctaatcccaccatacggtgggcaaaagttgtgcccatctcttagcatatgttaa

SEQ ID NO: 107444 - DNA, 737 bp, Homo sapiens
tagtttattataaaggaaagaaaatacctacatagcaacttcaaaatgataataatgtcataagagctaccagttattgtgaactaaggcatactaagacatttaaaggtattatctcactattttccctcacaataacctgtctgcccattgaagaaacatctgctttctctgatgacctattccaatatcttaaaaccattataaccagaaactctcactgtgatacggtgttttgaattttactcaaccctcttcccccattatcttctgtgacaaaaaggagacaaattctctaaaaagagatggactgcataaagtagaaaatgtctgagcatcacctgtcctgtgttcctggctaacacctcatgagtgggttccccgtgacccccaatctaggtacagctaccttaaaatgccacactgggctctaaatgtgcttcccacttttttgacaagtaatggactgaaatcagaatcttattaaaagattgtctcctgccattcttttaaataagtttcaatatcacagaatataataaaatttgatgagatttcttcttgataaaagttggaaaagtacttaatgaaaagctaattcaaagagacaggtaatataaaatgtttaattcaggaagatgcttaatgcaagaagacaaaccattcttccttgactcagttgccttcctacttgtctttttttaatctttcttttcttatgaaaagtttaagtgagg

SEQ ID NO: 107445 - DNA, 272 bp, Homo sapiens
gttctttggttgtaagcaagggaaaccaatttcagctaatgtaagcaaaggggaatttgtcagaactatatcagaggattttcagctggctggagaatcatgcttagaaactggcaaacaccaacaatgctcccaaaagcagctatctcaggcatagtttatagaagaagagagctgggtgtggtggttcacaactacaactcagtgctttgggaggctggaggtgggaggattgcttgaggccaagggttcaacatcatcctgggcaacat

SEQ ID NO: 107446 - DNA, 544 bp, Homo sapiens
gacaagtgaggatctcacactgggtcgagtctaattcctctaccaatggaaatgcttataggaggagacagcctatgcctccattcccattttatagatgtgaaaatcactacctatcgacaggaccaatttaagagtttcatgtataagtgtgatggtgctttgtaaatgacatacagcacagtacaaaaattttaagcctaactactgctaatagtcatttgtgattttcatgtgatgtttatataaggaatcttattacttcaaaaatatttcatagatttagaaaaacaaataggatattcaggatacagtatggctcattaatacattaaacttttcaactttaatttcttgttaaaagctccctgaaaatatattagtacattttatgtctgagtatacagggcaaaatggtgctagatatgtttcacggtgactgtcactcgtaactcctcctaaggaaagtacccagccttctggaccaggggaagttttttgttaacagtgagatctcttccatatccctctgggtaaatggacc

SEQ ID NO: 107447 - DNA, 340 bp, Homo sapiens
aaagtatttaagaattcctaaaggatcagaaattcttttttgagataattttccttaacataacaatgcatgtttatttgctgtctgatggccatggagtagtggtatgttatgaaaaaatgtcttaaatttgctgtgacagcctcttttcccagaagattagcatatcaaggtttgtcttctatatatatttgtaagctagataaaagtgttaattctaattgaaatggttcctttagtagatttaatgaaccctccaccaacaagtaaattaaactgaaaattattgacacaagttttatcattggagaagaaaataattaccaaaatcattgtctcc

SEQ ID NO: 107448 - DNA, 459 bp, Homo sapiens
atgccaccacacctggttaaatttttaaattttttgtagagacagtctcactatgttgcccaggttggtttcaaattcctgagctcaagcaatcctcctgccttggcctcctaaagtgctaggagtacagcatgagccactgcatccagcgtagactgctttgtatatttaaattatgtgtcgtacttagaagatgaggtgattaaatccttgataaaaatcatgattaaggtttttggtgtgattatatcttgagttgcctttgaataatagaagcttagtaggagaaagaagtttgtttactatatttgagttaatctctttagctcaagctaaaatagtatatcaaatattcctctgagtaatttaagtgtagatgacctcagtccacattcttacccttgctttttaggcaataatgtaccagaccctgttttaaagttacctaggaaatatctt

SEQ ID NO: 107449 - DNA, 964 bp, Homo sapiens
acctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacac

SEQ ID NO: 107450 - DNA, 745 bp, Homo sapiens
agtgcagtggcacgatctcggctcactgcaagttctgcctcctgggttcacgccattctcctgcctcagcttcccgagtagctgggactacaggcacccaccaccatgcccggctaattttttgtatttttagtagagacggggtttcaccgtgttagccaggatggtctcaatctcctgacctcgtgatccgcccgcctcggcctcccaaagtgctgggattacaggcgtgagccactgcacccggcccggagaactttgaagtattgttctatcgtgttcttttaatcaactgtgtgttcttccatagaatgtctttttggctggttttctgttattgaacatttaggttacttctgattttttttgttatcattgttattagaagtgatgttccaattatttgtctctccgcaaatctgcatgaggttttcaaaagtatataccaagaagtggatactgggccaggtgtggtggctcacgcctgtaatcccagcacttagggaggctgaggtgggcagatcaattgaggccaggagttcaagaccagcctggccaacatggcagaaccctatctctactaaaaatacaaaaaattagccgagcgtggtggcaggcacttgtaatctcagctagttgggaggctgaggcacaagaatcgcttgaactcaggaggcggatgttgcagtgagatgagatcgtgccactgcactccagcctgggtgacagagtgagactctgcctc

SEQ ID NO: 107451 - DNA, 228 bp, Homo sapiens
ttctcaagagggaagccaatatcctggacttcaaggtacttattaagaaccttctggcaaacagtgctctgtggacactgtaggccaggagctactagaacgtacagacacatccaagttcagaaatgcgaaggccagaatggacaaacagcaaacaagcaaaaatcatcaccttcaagctaatgaattttgtcagacaaggaaagaacacacctttgcgggaactgc

SEQ ID NO: 107452 - DNA, 274 bp, Homo sapiens
ccagaataagaaaataatgagattatactttcatggatagtacagctgagtgacagaaggaaaaattcatcggttgaattaagagcagagaagaaattagaactcagcactcccaatacctgatcttttgctgtaattactatggtgtcctgttataaggagagcccctggctccttggcctagtgacttccctttcccagtcttgccttccccatctgaaaatacaagaatgtagttccattgaagagaatcatgatgatcatgataggcact

SEQ ID NO: 107453 - DNA, 227 bp, Homo sapiens
cactccgccagctggccactctagccctcgccgcgcttccgcaacaagccccaccactctgaacttggaggtccgggtcaggggaccggcagaaagcaggacaggaagcatgcagcggtgcggagcaggtgagggcccaggaaaagccctgagctgggcaaggagggggccgaagggaaggaacagaaagggaaggagcaggtgagggagcagagaccaggtggggg

SEQ ID NO: 107454 - DNA, 851 bp, Homo sapiens
ctttatggtctaaataacatatctaaaatgaagtaaaataaaaagttttcagctgcaggaaatgcaaagagaatttaacaaaatatggtggtggtaagagatgttaattcatcatgtcagccattaaaagattacgtagaaaaaaaattagttgcaatttaaagggtctgaataaaatcgataaaaagttaaagcaaatgtagatgtagaaatagataacttgatagccagttggttggatggattgatgaaagaatgaattatggctatttctagagaatcactttattgcaataccttaggccatacacggaaatgaaacatatattagacctcaaagaaaacttttatatagcccaaaaaggtaaaataatatgaactacctcactggccaatatataataaaactagagcttaatagaaggacaacaaaatccaatcacttaaaaaaaactttcaaataattcttgagttacagaagaaatcaaaagaaaaattataaaagatgaagaaaacaacaaatatttgacaaaatgcaagaccattttgctattacaattgacctagaaaataatattcacggcaattttgaaaaagaaaagtaatgagggatgaactaactttatcagattttaaaatacatcaggaagttgcaataattaaaataaattggtactggagaagagcaaaataaaggggccacccatagatttgcatatttgtaacattaatttgtgataatagtattattttttaaataactgagaaaagagaaccttcagtaaataatgtggaatagctggctaattgttgcagaaaaggataaacctgtatccctatcttaatttcta

SEQ ID NO: 107455 - DNA, 329 bp, Homo sapiens
ccattatcaccactgcccacatggagcccaaaggggtagagagtaaggaggccctgtgacaagtaccctgggaggggcctagagttactatgggaacctggagtagaacataactctggcagattagggggttcaggaacactttctaaatgaagtaaagtattagacctgaggatgagtgggaattagccggttgcaggcaagatgaagagggccgcaggataggaatggaatgtatgaaggtccccagggcagccagaggactgagccagagtagtagtgctgagaagaggaagtgggccacagaaatgaagcagagaaggcgtctg

SEQ ID NO: 107456 - DNA, 446 bp, Homo sapiens
aaacatagaaatgtaaagactcttaggaaaggctgaataggctcagttgtctaggtttctggggaaacatgtcccccaaagagtttgtatttttttaactgaaaataattgtaaactaaacatttctatgatgttagctagtctttcttaacacattatttagtatttgtactcccacgaactctctaatagttattttaatgtttaatagcctgtaactgcttgctactttaattgaatttttttaactgcctgtttttaactgtgatttgtttaggacattgagtaaaaggtcacttgtactgttttaggaatgttgtgtttttgtctcattttattcaccgcctctacatgcgccttttactgttctgtttttctctttagctatcctcataccacccaaggcagtcttccacctggacagtttctgggctggccaccaggag

SEQ ID NO: 107457 - DNA, 408 bp, Homo sapiens
tcttatattggggcatttaggtagttttcagtttttcacaatgacagtccatctgcatctttgttgattgctaccggttcttttgtcaatttagtaactgagggctgaaaaaacctgggtttaggaccctttggtccttattagcccaaagaaattattagcactagaatcctggaaaccggctgttggagctggaagacactgagacatcatctcatccaatcatctcgcttttcaggaaggggaaattgaggcaccgagctgttcagtcacttggcctggggatcccaagtgggtctgcggttgagatggaaccgaaacccaggttttctgactcctattccgtgatagtctgcttttgtccaacagctaagactccttggaggacagagagggaggtttaagttg

SEQ ID NO: 107458 - DNA, 560 bp, Homo sapiens
aatgttttcccccttaaaaaaagaaaacctacaactctctgtatactaagagggtcaaagatgatagccatagtgtcaatgctgcttgaaagaggcctctaagaaagacatatgtggagagcacacattctagctgcaatccagtcttttcccatggctttgagctttgattagcaatttcaggaaaccaggaaaggtctacattgacaactacaaaccatccgattacaggaatctcccctaaaaattagtccaaggatttcttaatgttattttcattttcggtctacttcaaaatagtcctttatttttaactgtgaataactcaaagcagaaagtccgttcaaccttactgagcataaactacataaccagttcaaatggagcctgttaccaactccatccataatctttcagatgtttagcttaaatgttcctctgtggtaagtagataccattagcaaaaaaattcttcatgcctttttttttttaagagacaaggtattgctctgtcattcaggctagagtgcagtgatctaatcatggctcactcgaattcc

SEQ ID NO: 107459 - DNA, 743 bp, Homo sapiens
cgaaactatgagtctattaaacctcttttgtttatagattacccagtctcaggcagttctttttattttttttttgagacagaatcttgctctgttgcctaggctggagtgcaatggcgcgatctcagcttaccgcaacctctgcctcccaggatcaaatgattctcccgcctcagcctcccaagtagctgggactacaggtgtagtttttaatgttcatgacaagtctttattttgttctctataatttttctttattaaaatgttccataattcacttgtgtttctttcataaccagattgtgaaccaaaaagtgttattgtttttgtttggttttgagacagggtcttgctctgtcttaatacatatttattgatttattgatttatttttgagatggagtctcactctgttgctcaggctggtgtgcggtggcgccatctcggctcactgcaacctccgcctcccaggctcaggcaattctcctgcctcggcctctctagtagctgggattacaggtgcccaccaccacgcctggctaatttttatatttttagtagagatggggttttaccatgttggccaggctggtcttgaactcctgacctcaggtgatccacccacctcagcctcccaaagtgctggggttacaggcgtgagccactgtgcccagccaatacatttatttttagatgaacattgatgcgaaaatccttcataaaatactggcgaactgaatcca

SEQ ID NO: 107460 - DNA, 523 bp, Homo sapiens
gtcacatacttgtaatcccaactacttgggaggctgaggcagaattgcttgaacccaggaggcagaggttgcattgagccacgattgtgccattgcactcaagccagggcgacagagtgagactatgtctcaaataaattaattaaataaaatggatttttaaaagattttggaatgaataacacatttaataaattagttttaaccctcagaggacctataagaatataaacaaaattgaaaattgaagcatttgttcttaatcttgattgaaagactaatcagcatatctgaaaccctggcctcagaaaaatataatatttgatgaaatcacagataacaagacctatgtaagggtgctaatactgcgaaaataaaacccaaattttatataaaaaggactgtgactggtcaaggtggtgtgcacctgtagtcccaggtactcaggaggctgagacaggaggatcactagagcccaggagtttgaggccagcctgggcacatagcaagaccccatctctta

SEQ ID NO: 107461 - DNA, 513 bp, Homo sapiens
tttttttttttaattccacgggatactgtcaagaccaggtgatgagaggctgtcagcctgcaaggccgactttgatctttatacaaagtaaaactagtggaaaaagaaaggcccggttcttgtcaaaggcaggacattcaccattgggcgggtagccaagtggttgcttttgctatcttattcttccctactgtggtgtctcttaaaacactggacaggactcttctctctcatttgaggtaatagatttggcttcaaaatcacctcttgcctcctgaggtggcagattattctgaattgctgcagacttaaaccttggcctgcaaaggccatggtggtaataattatttcactttaaccaaacagaagagcacataagaggatatcagttatcctgacagcatagctatgatgtggaagccgtcctgttagggaactgctgagtggctaaaaagtcacaaatcatttttctctgttctttcctctttcttttgctcaataacaccccccacc

SEQ ID NO: 107462 - DNA, 258 bp, Homo sapiens
cttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactgg

SEQ ID NO: 107463 - DNA, 202 bp, Homo sapiens
aaaaaatctaaagactcttccaaaaaaaaaactactagaactgataaattcagtgaggttgcaggtacaaagtcaacacacaaatatcagtattgtttcaaagtcaacacacaaatatcagtattgtttctatatgccaacagtgagcaatctgaaaaagaaatttaaaaaagtaatctcatttgcaatagctacaaataaa

SEQ ID NO: 107464 - DNA, 586 bp, Homo sapiens
cattacaaaaagaaaataatatttcctattagagcctgaagcttttttcctccctagctcttatttagggagaatatataatttaagtgtttgaataggaatagaggaagtagccaaacacttttcaatagtccagctaaaatacacaatagcacatgtttaaagtacatctttggaagaaagatttgaagatccttgataagataatatatcatgtaccacaaaggcatgccctgctaagtaaaagtgggaagaagcagtacatattctattagggggtcagaaatctttaaatagaagtttctctggcaatctggttcccagatagatagttgaaggctcaaagaaatttccaagcttgctagaaatttccatctgctggcttttgtgttgagttaaatgccatcatattttattgcctcatacatttgcattaacactttccctttaaatttacttaaagtattttttgttttgtttcatttttgtttttttttgagactggtctcactttgtcgctcaggttggagtgtagtggagctcacagtttacttcagccttctgagtacctgggactacaggtgca

SEQ ID NO: 107465 - DNA, 339 bp, Homo sapiens
agtgtttatatatgattataagcaagcggctagcagggaaaccatgggtaaagggttaaaaaactctcatttgatcttcgtttccctcctaccaccacttccactgagataatttcaagattatctccatctcgaaattgaaaaacttaggcatagaggttaagaagatgacccaggttcatgttgtgacagttgggattagaacctaggcagcctggtccagagtatgtgctcttaacaactacagtttgatatcatcctttagtttttttttgtcattcagaacggtttacttttgcatatagtattatctattacagtagttaagacaatgcagtc

SEQ ID NO: 107466 - DNA, 167 bp, Homo sapiens
gctcaaaccaaacacttcggagccatccttgattattctctttctaccacccccacattcaatccatcaaattatatcaatttctatgtcaaattgttcctaaattcccccgttctttctagttccaccactaccacctcggtccaagctgcatcatctcttgccta

SEQ ID NO: 107467 - DNA, 377 bp, Homo sapiens
agagaattcaaagcctaacaaaaacaattatcccctagaactggtcctgacggctgcatttgacacagaaaaacatgaaattagaattgtgaggtgggggtagggaaagtttccagtattccaggcaactcaccacagtaaaaggatttttaacagttattttactaaggaaggatattttcattttcattttcgttggtttagagtgatttaatttgcccatgaaaaaaaattgtgctactgttaaagtaaattataattcaatttatttctttattttgttttattttatttttttgagacagagttttgctcttgtcacccaggctggagtgcagtgccatgatctcagctcactgcaacccctgcctcccagg

SEQ ID NO: 107468 - DNA, 162 bp, Homo sapiens
tggaaaggaaggactctacatttttcatactctgccactgtggtgccaactctacacaaaaacactcccagtcatcatttttaggagcagctagaccttgatacagagcaagaaacactgggatatggtcgccttcatagtaatggtgaacgggcatcccca

SEQ ID NO: 107469 - DNA, 353 bp, Homo sapiens
ggaaaaaaaatcagccacactcacagcatttagaacattaataagatgctttataaatatggttggttgaatgggtgtactgcctactcctacacctttacttatgtcattccatcctctttgtatacgctggtgagcatcttcagtgcacgtcacctgggaagctcattaaaaattcaatccttaggccctactccataaattttgattgactaatctgagagagagcccaggaggaatatacattttaactagcagcccaagtattctactttgagaaacaaagctgtatactcaacaccacctgtatgtgcctgtgcaacaggcatttgccttcagcatgatgccattac

SEQ ID NO: 107470 - DNA, 347 bp, Homo sapiens
tgcccctctccagactcactctcctcatctataaaatgggaacagttcctaccggctgggcaagctggtcgatccactgaaaaccctaaaaacagagcctggcacttgtgaaaacaacgttctaaggcgtattttctgacaatttgggcggaattcaagaaccaaatggtgctagcattcctgcgctgtgcccagattatgggattcgtgtcacctagggttgggcgaaaggcacaggcaagtaaccagagtcactgactcactaattttaccatttttaactatttcagattagggaggagcctttcgccaagtactgagctactcagcagctttggtggctccga

SEQ ID NO: 107471 - DNA, 423 bp, Homo sapiens
ctcaaactgactttacatctgggaaaggagaaattgtaggtctctcttactctgggatatttttgatagagcaaaggtatccatgatgtaaatttctgagatattatagataagccctttataaagtcacaaataatattcccataatgaggggggaaaagattccaaagaaggctgagcacttactgagggcagggaccatcattgtctcctgctttacagtatctgcaactcctagcatatctggtttacgtcttgccaactaaaggtaatgaggcttccctggaagggcactgaatccatggccagaaagtttcacaaggaggcagctgaaataaccagccacatagctcatgggggaacatcagtgcacctcagggggttggcattctgggagaggtcctctcagctcagatttctttt

SEQ ID NO: 107472 - DNA, 322 bp, Homo sapiens
catcacagcccaaatgagcagcagtaaccacttcacaacttcttgagcttccccttccccgcttttcattctatttgtttcttcatattcagaccattttttccattgctgccagtggcagttccatcctcttccatcccaacttaacaaaccacaccatcaaaatgaagggcagttccaaaacgcctgttagctatgccagataaaagctgacatttctggctcttaatgtgaaagtcaggtgacctgctaaagacaactatctgttttgaaaatatgttctttttaacttctatgcagctcctgggaagatagcccagcc

SEQ ID NO: 107473 - DNA, 433 bp, Homo sapiens
ggaacattaataacagagggaagttccatacatgtggtataggggccacatgggaactctactttctgcccagttttgttatgagcataaaatgatctaaaaaataaagtctattaaaaaacccatcaatctatttgcagaaatagattgatcctaaaattcatggccagacctggtggctcatgcctataatcccaacaatttgggaggctgacttgggagaatcgcttgagccaagaccagcttgggcaacatggcgaaatcctgtctctacaaaacactacaaaaattagccaggcatggtggtgcacacctatagtcccagctacttggaaggctaagatgggaggatcgcttgagcctgggaggttgaggctgcagtgagctctgatcaagccactgtactccgccctaggcggcagagcaacaccct

SEQ ID NO: 107474 - DNA, 437 bp, Homo sapiens
ctttctaggcccaaccccatgttcctgagagccagggggaaacccacaaagtgtgatctcctgggcctcaggaagcagctttatttacttaggcaaattagggctgcagtatatttgatcctggcccttaaaatcaaaggttctgtcttgggaaagcatagattggtgaaagatgatctatatagaattttaaaaatcataaacagtctgggcgcagtggctcatgcctgtaatcccagcactttgggaggccgaagcagacgaatcacttgaggctaggagttcaagaccagcctggcaaacagggcgaaaccccgtctttactaaaaatacaaaaattagccaggcatggtggcgcatgcctgtaatcgcagctacttgggaggctgaggcacgagaattgcttgagcctgggaggcgaaggttgcagtgagctg

SEQ ID NO: 107475 - DNA, 692 bp, Homo sapiens
aggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatccgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttt

SEQ ID NO: 107476 - DNA, 332 bp, Homo sapiens
ggaggaaaggattggcagtatttttttaaagggagggagatgataaaggagagtaccccagagagttgcaacaataccacttggaagaaaaacttcagtcctgctgttgcaagagtggtcatgtgctgttcatgataggagggtattggggaagaaagattaagactttcacagctgtcagcattcactgaaaaatacctctgttgtcacttaacgtaatttcttgtcccttgaaataagattttgattaaaaatggaagagtacttgtaaaagtaataggcatattacagacagaggtcagtgaattgaaagtcagaagaccagtatttgc

SEQ ID NO: 107477 - DNA, 202 bp, Homo sapiens
agtgtatttcccttccggatccagttgtaggagaaggagaggagcagtctgggagaggcttaaccagggagggaggcggagggggcgggagccggtcccaccctccggatgcctgggatcgagggggtatcagatggtgatacaggccagtgcctggtgatggatgactttctacagggagaggcacagcggggagcccgag

SEQ ID NO: 107478 - DNA, 290 bp, Homo sapiens
ggtcgacccacacaaagtttcactagtcatgctggaagctcagtgcggacaagtgtgagagattaaaactccagagaaatccaatcattgggctctcaagtttttgttaagttttacttccaggagttctactaggttctcactataaatactggagaaaaatcccctcatatttccaccagcagggagaagagaaaagaaaccattttgaagtacgtcagagcattccattcttaacaaaacctgacctcaggagaaattcttttttctacagcctcatctgtcgacgc

SEQ ID NO: 107479 - DNA, 759 bp, Homo sapiens
tttagtgtctaccttcaatatttcttgtatgaagtttcagctaaaaatgtactttgtgtatctgtagagtggcttcatattcagagtttatggacatttatgattttatgtcccctccttggttcttatctcctggagttcagccttatgtgcttctcaaagtgtataacaaaatcaaagacaatgtcatgtcccttgaatttaattctaacaccaaaccttggtgttagagtcacaaaaagtccttttttaaaaaaacttggtgagaacagacaataacttgtctttctgggcattcgcgtcatggtccttttagccagaagagaggttttcttttgcatagtttggtgagcatcaagaatcctttaaggagggtggcggtgctgacttctccccattgagagtcagcctcatcccctcctcagccttgtggatggagaagaacaggcagtgatatacattttctgctgttgaaagatgtccgcttatccttctctttcagtgaaaagttgcttttttattcaatatgtactgaacaggttctagagtttcagaaacaaaagaaacagaaccaacatttatagatctcactatagaggcatcactaattggggaaagacagactaggtaatagtcagatgtgatatagtatgtttaagctataggatggcaggtgcatgagtgttggttgtattattctttatttttttgtatgacttatgatattcatgataattaaaacgttttggaacaattcat

SEQ ID NO: 107480 - DNA, 113 bp, Homo sapiens
ctatggaagaacaaatgtggaacttcttggtctcagattaagggctttgtgcatcatttgccagatggtgtttcaaatgttcacaattctttctttcaacttcaggggtatat

SEQ ID NO: 107481 - DNA, 393 bp, Homo sapiens
atccatggtcaaaggcctaatgctacagattgtgggggtggggcgggagtatcatctccctgatgatgtcatactctcaataaaacccagcaccacagtgatcgttctaggtcctctcatatatatacagtgccacccagcacatcagctgtactctatatttttaatgaaatgtgacattcaaaatccgaacttactaaaatgtaaataagggggtaattaccaagacattactttaagaaagaaatcaccgatcagttcctctaatgccttgttctctgtttaaataccactggctacttaacagagacattaacaggtatgtcaggtttgatcagaaataaattcattgcacagagctggttgtatcccgatacgacagctaaaagtaga

SEQ ID NO: 107482 - DNA, 1062 bp, Homo sapiens
ataaaaaccttaaaaaagcagctgagggtggtgtgtgcctatagtcccagctacgcctgtagtctcagctactcctgtagtctcagctactcctgaggctgaggtgggccaatcacttgagtccaggaggtgcaggaggttgcagtgagctgagatgatgccactgccctccagcctaggtaacagagggagaccttgtctcaataaaaaaaaaaaaaaaaaaaaaacgcgtgggtttttatataatctcgcaaagatggattgccgtggttttggaaaaaccaaattcgccctgtgccgccttggtgtcggagcccctttattgagggcttatactacagagccgaaaaaattagcgttagagatttcacctttttataaactcctgtggttaacccaactccttgctcggggtacgccccccattttgggacgggaaagatggggggtggggatggccaactggcttttggtcccccaagaaatttttcaactcccttattgcacagtaactttttttggaagtgggccatgtggggtgctcaactggggaggtccattaaacttactaggcaggtttaataccttcctaatgcgggggtgtaccatttagccggcatttcccaggtacgcccatttttctttaaattcccaaccttttagatttttccctttctcaatctcgaaatactctgtgggagaccttctcttcttttaaaaacccttaaaaaacgcccgctgggggggcggtggccctattatgtcccacagtaagcgcgtaagtctacagcaaccccgtgaggtctagcaaaccctggaggcgggggggggccacactgggtccggaggtggcagaggttgcggagcctgaaatatgcccgccctcagcgcctggtaagagggacctgctctaaaaaaaaaaaactcggtttttcgtgcgaaaggtgaaaggcaggcatggtccgaccctgtaaggaatgggcctagagtatagtgagctggaaaaataataaatcgtcgcacacgcacgaccggccatactctgcttatgagccgaaaaag

SEQ ID NO: 107483 - DNA, 406 bp, Homo sapiens
ccaccagattacaggagaatggaatcccagcctggtggcacctaccagctccagtgctttatcagatacacccatagtggtttcaaaaacctacaggaatattcctttgggaaaggaacccgtgaggttgctccctgggccggctctgtgttctcactgccccagcttgcacctgagccccgctgcccctggggccgttggcctgctaagatgctttgggtttctctgcatcctcctttgtatagtggagtgcatcgtgctgctcaggctttgtaacagagcaccgcaggcgggtggcgtgcactgcagacgttacctcctcagggtcctggaggctgaaaattcaagatccagatgtgggaaaggctgattcctccagaggcctctctcctcagctggtggacgg

SEQ ID NO: 107484 - DNA, 358 bp, Homo sapiens
ttatattttatacatttcaattgattgtactatattgcaggatatggagatttcatcacgtactacaatacagtgtattttgttatatttgacgtatattctacttgtattttgtactgagatcatacactatttcattatctaagtgtattaattgtttggttgctttataattttcattttatgtaatgaaataaacaatgttgtttggaattttaaatttctttcatatggaatttgtatttaataaaaatgtgaaaaagagaatgtcttatcgtcacttccgtgtcatcctatccctgacctccccacagcccacagctcttgtcatagtgcgggaatagtgttctatcactac

SEQ ID NO: 107485 - DNA, 196 bp, Homo sapiens
agaagcagttagaaaacaataaccctggccaaagtgaatcaaactggacacagccccagcaaggcaagggaaagcccctgttgagagacaggactagctggatttcctaggcagactaagaatccctaagcctagctgggaaggtgaccacgtccacctttaaagatggggcttgcaacttagctcacacccgagc

SEQ ID NO: 107486 - DNA, 512 bp, Homo sapiens
agtgaggagactctgtctcaaaaaatatatatattaaaaaaaagaaaaaaaaaagtaaactaggaaaacacatcagcagcctgccaacagactcccctagcctcggtgagggccagtgttctgggaggcagatctgaattctagtcctagttcacccactggcaggctggtgcccttggcaggtcgcttctctggggctcagtttcttcctctataaaatgagatcaaatcccatgttctaagagtttgtgctctggagtcagacagatctgggttctaccactgccagctctgtgatcttgtagcttcagtctcgtcatctgacatggagataacagtaactgtctcactgtgttgttagggtttaaaggagataatgtatgtgaaatgttagcaaacaagtgttagctaccctgatttccggtttcagagttctgtggtcccagtttatgccacatgcagtgacgttgtatggtaggctgtggtgtggcaccacttcagaactcagcgca

SEQ ID NO: 107487 - DNA, 444 bp, Homo sapiens
gattgtccttgcagatacttagaagttgtacaagtctgccctggctatcccttcacctgagctactatttcgagacagctgtctactctgaaggttacctcttgctgtaactgtatttccaggatgctactgcagaaattataaagaaaatgactcagatttgtttgtgttaaaaaaaatcaactagaagtaatatgcagcatatatgacaattcaaagatcttaatgtgtaaagtgttctaaatgcaataatgaaaatgaattttaatttataaaattaaatttaaaataaaattatttagaggtaaataaatatagaaaaataaagtagggcatggtggctcatgcctgtaatcccagcatttgggaggctgaggcgggaggattgcttgagttcaggagttcaaaaccagcctgggtaacctggtaaaaccccatctctac

SEQ ID NO: 107488 - DNA, 487 bp, Homo sapiens
ggctaatttttgtatttttagtagagacagggtttcaccatgttggccaggctggtttcaaactcctgacctcaagtgatccgcctgccttggcctcccaaagtgctgggattacaggcatgagccactgcacccggccatcagtatcttatttaacttctcgaatatatcaatcctccagccagatctcaccccaaaacatgattaacctctcaaggctgggctgagtatctggcagatggacaagggtggcacatctgcctaccttgtcccagggccccactggggaggagggtgacagcaggttctctgggctgggcccgggtggtctctgggctgggcctgggtggtcactgcagttggcatgtggacagtgcctgacagaggactgaggcccccacaggggacaggagtgttcaggagagctgggcctgttgggggtgggagtccttagcctggctgcccccaaccctggcctccctacctc

SEQ ID NO: 107489 - DNA, 824 bp, Homo sapiens
ctgcctgcctcggcctcccaaattgctgggattacaggcacgagccaccacgcccggcctaatttcatactatatagttatctattgttgtcccatactttatctttctaagtccacactatctatggacatagaataccacctgtactctattttgttcattttcttgccgagagaaaagtgtttcttctagtcagattctttgttttctcctgaactacccaccatggtcagtgactgtagtcttaagactcagacaaatctagcagaatgccatattggatttttttcccccacattcctctgaaagtagtccaacatggattttactgttgttttaaaccaaaataatggtagtataacactctttcatttatttttatcaaagcatctgtggaaatatattccatttttcaaatatatcagtgctcaagtgtcatcatgaaagaacaactaaccaaactgtattgaagatggggttgtaaagagttttacatgttgatcacaataatacatatttttggttcattttgttttcttttataaataaatgtttcctttctttagtaggaacaactacaagagctttccctgttttttttggtatactttcttgtgactgacaggtatctgaggccataagagtattttattttaaagatgagggcaattgagttcagaggttggataacttgcccaagaccctataacaggcaagcagcagatcccagaatcaaacccaggccgtttgaattcaaattcacttcctttttcactatggtacaagaattggaaaataagagcattcttttgcatattagaga

SEQ ID NO: 107490 - DNA, 564 bp, Homo sapiens
tgatagcctttagttcaaaagtatgtgcctcatggttaacctttctgatgacttgtaattattaacatcagttatgagcagtcactatccaatacctacctttctagccatactattttccagccaaatcgaatacattgctttacccacctcaaccccttctccacctttacctctgtctaggggtttgtccaaatccaaccaagacctagctctgttgtcaacgctaccatgaagctagaaataacctttgccttctccaaaccattgagaggttctttcacctcttatgtggcacttagtgccttccactttgtaatatcgttattcatgtatatcttatttccactaaatacctgtgacagttagtactgtcccatacaaatctatgctccacagcgcttaaccttgaacaagtaagcactttaaaacattagatgatgctggcatggtggctcacacttgtaatctcagcactttgggaggccaaggtaggaggaatacctgagcccaggagttcgagaccagccagagcaacatagtgagacccgtctctacaaagaa

SEQ ID NO: 107491 - DNA, 390 bp, Homo sapiens
aataatatatttggtttttattctggttcctgtcacagagctcctaaaacccttggaatttcctgagtgatagggggtaagaagagcatcttttgttatccgtaataagccccttccagctggacctgagtttatgctaatgaggtgactcttggatgatggaggctgattgccagagaaaccaaccacataattagtgggttgggattttcagtcccatccctcaacctccaagtaggggagagggggctggagtttaagtgcaatcaccaatggccaatggtttaatcaatcacacctacctaatgaagctccataaaaacccctaacaatggaatttggagagcttccaggttagcaaacacaaggaggtactaggagggtggtgca

SEQ ID NO: 107492 - DNA, 312 bp, Homo sapiens
ccaagatcgcggcactgcactccagcctgggcgacagagactccgcctcaaaaataaataaataaaaataaaaaataaaaatctatgaatattctacaactaaaaaatattaatataattgaaattaaaagctcaacagatgggtttaacagtagacatagtagaaatgggtgaactggaagacagtaacaaagatccaaactaaaagcacagaggttaaaaatggtaagaatgaaaaagaatgtaatggacaagtgagacacattgaaaaggccaatggtccaacatatgtataactggaggcccagaaag

SEQ ID NO: 107493 - DNA, 545 bp, Homo sapiens
taaaagccggactcttccggtgaagcggaggtgtggtggggcttgctgggatcatggcggggaatcactgcgagctcctgccgctggcccgtggcaggctcggggcggggttggggtggcttcttgtgcctcccttaaagcgcggggctcagcgtcctggcccagcgccccagcagcaggtccaagtgggtccggctctacagcggcggcacctacttcctcaccactgggcagacgccgctgtgtcaggacccgaaatccttcctgtacctcttgagccaggccgaccccgacccggactcggacaagacggagttttgttcttgttgcccaagctggagtacaatggcacaatcttggctcaccacaacctctgccacctgggttcaagcgagtctcctccttcagtctcctgtaatgccagctacttgggaggctgaggcaggagaatcgcttcaacctgcaaggcagaggttgcagtgagctgatagcatgccattgcactccagcctaggcaacaagagtgaaatttcgtctcaaaaaaa

SEQ ID NO: 107494 - DNA, 807 bp, Homo sapiens
taaaagccggactcttccggtgaagcggaggtgtggtggggcttgctgggatcatggcggggaatcactgcgagctcctgccgctggcccgtggcaggctcggggcggggttggggtggcttcttgtgcctcccttaaagcgcggggctcagcgtcctggcccagcgccccagcagcaggtccaagtgggtccggctctacagcggcggcacctacttcctcaccactgggcagacgccgctgtgtcaggacccgaaatccttcctgtacctcttgagccaggccgaccccgacccggactcggacaagacggagttttgttcttgttgcccaagctggagtacaatggcacaatcttggctcaccacaacctctgccacctgggttcaagcgagtctcctccttcagtctcctgagtagctgggattacaggcatgcaccaccacacacagctaagttttatatttttagtagagatggtttcaccatgttggccaggccagtctcaaactcctgacctcgtgatccgcccaccttggcctcccaaagtgctgggattacaggtgtgagccaccacacccagccaattagggctgtcttacaaaaaaaaaaaccaccacgaacctttgcgagaatcgagcgcagcctgtgctggttgtgtaagccgtgggacacacgggaaagccaggaagaagaggaagagcacccccacaccccacccgcgtgaagaagagcaaccccactccccgcccgtgggaagaagagcaccctcacgccgggcccgcaggaagaagagcacccccacgc

SEQ ID NO: 107495 - DNA, 599 bp, Homo sapiens
ccaaatggtagcacaaagagattgaggtctaattaggagctctaccaggaaggaatagggagcaggccattttcgaagaactgtgtggccaaggattttccagaattgaagaataacataactcctcacactcagcacagtgagtctgaataagttaaatatacacttacaaacattttgctgaatccttagaaccccagaaatggatcttaaaagtaatgagagattaaaaagatattataaaggaataacaaatagactgacagtgtgtttctaaacatctcatcaagaaaatgccggaagacaagtgaaataacatcttcaacatggtgagagaaaactgtcagcatggaattctgtcctcagttaatccatgaaggtgaagtaaattttctcagggctttaaggactgagaaagtttatgaagaagagatccttgctgaaagaactactcaaggatgtactttggcaagaccctaaaaaaaggaatgagatgcaagtagcagtgatgagcagatggccagcatttgggtaaacaagcaagtgtcagctatccggaaccaaacaacactgactagtccagatgtgtgtgtgatggg

SEQ ID NO: 107496 - DNA, 370 bp, Homo sapiens
ttgtgacagagtctcactctgtcgcccagggtggagtgcagtggcgcgatctgggctcactgcaacctctgcctcccgggttcaacccattctcctgcctcagcctcctgagtagctgggactacagatgcgtgccaccatacccagctgatttttgtattcttagtagaaacagagtttcaccatgttggccaggatgatctcgatctcctgacctcgatccacctgccttggcctcccacagtgctggcattacaggcctgagccaccatgcctggctgttggtatactttaaatggatgtaattcattgcagattatacctcagtaaatttttatttagtttttgagactgagttgctctgttgccc

SEQ ID NO: 107497 - DNA, 878 bp, Homo sapiens
tgaggaacctacagcagagccgttagatcattggcaagtcctccaggcgacctcgcccaagttgggcaagagcggctccccggctggccaccaaaaatcgggcctgatctgatttggtttttttttttttttgagttttgctattgttgcccaggctggagtgcaattgcgcgatctcggatctcggttcaccgcaacctcggcctcctgggttcaagcgattctcctacctcagcctcccgagtagctgggattacaggcatgcgccaccacgcccggctaattttgttttttttttgttgttgttgttgttttagtagaggcggtgtttcaccatgttggccaggctggtcttgagctcccgacctcaggtgatccgcccgcctcggcctcccaaagtgctgggattacaggcgtgagccaccgcgctaggccaagaaggatgtattttaagaaagcttcctgttcaatgttcccctgctctgtgcgcttctctgggcggtggtgtaaaaggaagccccttcccttgaagtatcctggtcgtcaaagaatcttcctctatttacaattataaaaccccgtggggcagaaataactagatgtcatatatggcgtggacatggtggtaaccgcatagtaatgagtcttaaaggctttggggaggccacgcaggggacggactggcttggagccccgggagtttgagagcttccgtggcagcatagtgaaccgcatcttttgacaaaggtcccaggttttcccagaccagcacgggacatttgactccgggaaccagttgggagaccttagccagggtctagaggcggtcacgggctaggtcttagcaagcgaaaatacgcttgtagtgtcacgttgcc

SEQ ID NO: 107498 - DNA, 548 bp, Homo sapiens
tgtagagacagggtttcaccacatggcctaggctggtctcaaactcctgaactcaagtgatctgtcagccttggccacctaaagtgctgggattacaggcataagcaaacatgcctggaaaatatcaaaatttcttaaccccctgtgtatttggcacctgtctaaagttttgcatttacttatatttttaatctttatagttgcttggcatagtatcttctggaagtttattgcctattaggaagcagtattctgtaagtcaattagtcatgaatgtatacctctcttaggcttttcaggaagaaccttttcttcatgtattctaggatgtagtgacaaagtctattattacttcattgtataccactttatctgtattgattcccagatggaagaatccaatcctttttagtttatcattataaatgattctcccattcctaatattaactgcccttttgagatgttttattacactgtatctttgttttcacaccagtgaattttaaaatttgttagtttcttgttattacagtcatgttctgaca

SEQ ID NO: 107499 - DNA, 287 bp, Homo sapiens
aagtcctgtgagtttgtgaccgcggagtcatgggcagctgtcttgggatggggctgagctgtctgcatgaatagaaaggtatggaagagtctcactatagtatagtgcagcatggagactagcctctcggttttcagaatcttcttggaaagaaaacaacttgtaactgagattctaagaaatttgggaaacaaaatttatggctaatggctgaggcaaacaagaaaggtggctcaaatattggaatggaaagcaggaaaccctaggttttagttctggcatcgaca

SEQ ID NO: 107500 - DNA, 398 bp, Homo sapiens
aagaaagatgtgaggatcaagcagacaatacctataaaatttatgctctttatttttcaagggccacataagtgtagtcacatagttactttatcttcttcctgtaactgtcctccctctaggcagagggatggcagtcattgacgatttatgactctgaagagctgatggggggtgtggcaaaacatctcatcttcctccattcacaccctccaagcaccttgaataattgctgggagataacttggcaattgtttggctaactgtggccttaatttcctgccagggcttcactcacgcctacctgtcctttccgttcctgattagtaagacaacattcagcgttccttttctgctaaaaaaaaatggagtgacttttgtgactgttgatacagatc

SEQ ID NO: 107501 - DNA, 729 bp, Homo sapiens
gggaggaaatatctgcaaagtattcatcttacaagggactaatatacagaatatacaagaagtcaaaaaacaacaacaaaaaatccaactaaaaagtgggaaaaggatctgaatagacatttctcaaaataagacatacaaatgggcaacaggtatacgaaaaaatgctcatcatcaccaatcatcagggaaatgcaaatcacactgagagatcctcttaccacaattaggatggctattatcaaaaagagaaaaaataacaaataatggcaaagatgcagaaaaaaggcaataattatacactcttggtgtataattagtacagccattatggaaaatggtatggaggttccttaaaaaactacaaatagaactacgatacaatccagcaatcccactacttcatatttatccaaagaaaaggaaatcagtatggcaaaaggatacctgtacccccatgttaacattattcacaatagtctagatatggaattaacctaaatgtccatcaatggttgaatggataaagaaaatgtagtacatatatataatggaatgttagtcaaccataaagaagaataagaatactgctgtcatttacagcagtatcattagaatcattatcattaactaatgatataatcagtatcattagttcattatgttaggtgaaataagccaggcacagaaagccaaatattgcatattgtcactcatatgtgggagcag

SEQ ID NO: 107502 - DNA, 605 bp, Homo sapiens
gggtgtaccccacaaatgatacagtaatgaggatacacaattaaatcccatagcatgactgaaagctttcactgtgtttgacatcatcacaatggaattgcctaggtttcttagctaaaagtaagtttgtatcttttattatttgatagtggggggttagcgtcctagaagtcccagacttaggttctcaattgtcttaagaaaccatccatctgtattgacaatatgggtgctctaggggcagtcttaagcccaataagaggtcttttagcgcactgagcttttgctctctagggtcagtgtttggatttgaatatccagcactgccactcaccttgggcaagtcatttaaactgcatgtctcagtttcctcatctgcaaagggactaataaacacacctacctcctgggatggttttgaggaatacattggctaatatatgtaaagcatttactatgtgccagaccctgcaataaatgtgaaagtagtctctgttactacataaagggcttctcatttagccaaaattttattacattctagtacacttacgttgagtaatatgcagctttttcagtggatacttcatttcaaccttacagag

SEQ ID NO: 107503 - DNA, 498 bp, Homo sapiens
cgtgtatatgacagtcttggctttttggttagaagtagcatcttgttactgggaagaagggcacacagctcttctctgtaattaatgaatctactcactaaatatttatcttaggaacacacttacttctgttatccattgtagccccaaagatagagatggttacaagtacgtgatgagcatctagaaaattaaggatgggctgggtgcagtggctcatacctataatctcagcactttgggaggccaaggcagaaggatcacttgaggcctggagtttgagactagcctgggcaatatagcaagaccccccatctctatacaaaaaaaaattaaaaattatctgggcatggtggcccatgctgtatgtagtcctagcttacttgaaagactgaggcaggaagatcacttgagcccaggagttcaaggctgcagtaagccatgatcatgccactgcattccagtctgggcagaagagtaggaccctgtctcagaaga

SEQ ID NO: 107504 - DNA, 630 bp, Homo sapiens
tttagtagtatttctggtctggggcaaattacactaataactacaatcccccaccctccccaacaaatgagtatgataatataatcatgcgccttggaggatttcttggataagtaattttaaacagtccaaatataaaaaatgaatactaaatcaatagcatgcttaatccccactaggtccaactcagattacttcttttggatggaagcttcaggcctttgtggtgtcccatatcttagcttttcagagaattctgtcctcacagtgttgtttatagacagtgatggaagagaagaatcatcacagtaaacatggagagtatgatgttccgaattttcatttgtccctgtcgctgagccactctacagcttctgaataagtaaactgaataacccgcaataaactgttttctcccataaaaaatcagttgcataaaagggcaggttaatgatgggaaggcagcaggatgttgtttagtctaagggtggacaattttgggaggctgatggctctggccaccctacagcctttcgtgtttccgatgtcactggggatgcctggtggccctttggatcccccgtgggtatcccaggcactttggcctgtccaggattcctggcctcgttt

SEQ ID NO: 107505 - DNA, 442 bp, Homo sapiens
ttatgtctttgcctgtaacttctgcctgtaacttggataacaatcaagctgtacccaatcaccttgggcacatgttctcaggacctcccaggactatgtcacaggtcatggccctcacatttggctcagaataaacctcttcgaatatttaacagagtttggctttttcatcaacagtgccatcacctcagagctaggattccaggggtggtctgggaagatcctttcgctgggggccgggaacagggggtgcaggggaacattaaggccagtgtggcaggaaaggtttcctggacagccctggagcagcatgaggtttggaaagcagacaggcaggctggccctaaatggtggaaggtgctctgattggatctctggcttctggggatagcagagggcaaacaggacacagggagtcaggacccagagccaacctccctaa

SEQ ID NO: 107506 - DNA, 421 bp, Homo sapiens
tgcatcctctccctgtgctctgtgcatcccccaatccatgctctgtgcatccccgccccatgctctctgcatcctccccgcctctgctctctgcatccccaccccaggctctgtgcatccctgccccatgctctgtgcatcctctctccatgctctgtgcatcctccccgtgctctgtgcatcctctctccgtgctctgtgcatcctctccccatgctctgtgcattctctccccgtgctcttgcatcctccccgtgctccgtgcatcctctctccgtgctctgtgcatcctctccccatgctctgtgcatcttcccatgctctgtgcatccctcatgctctgtgcatcctcccctccatgctctgtgcctctccctgtgctctgtgcatcctccctgtgctctgtgcatcctctccccgt

SEQ ID NO: 107507 - DNA, 655 bp, Homo sapiens
ttcggcactagcagatctggagagcatccgtcagtgtggagtggccctctgcatcgtgctgggattctccatcctgtctgcatccatcggcagctctgtggtgagggacagggtgattggagccaaaaggttgcagcacataagtggccttggctacaggatgtactggttcacaaacttcctatatgacatgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgactttctgggctggatcttgcctcgtgccggcc

SEQ ID NO: 107508 - DNA, 562 bp, Homo sapiens
ttcggcactagcagatctggagagcatccgtcagtgtggagtggccctctgcatcgtgctgggattctccatcctgtctgcatccatcggcagctctgtgctcttttacttggtttccgtctgcctgtgtgttgccgttattgtcgccttccagttaacagcttttactttccgcaagaacttggcagccacggccctcctgctgtcacttttcggatatgcaactcttccatggatgtacctgatgtccagaatcttttccagttcggacgtggctttcatttcctatgtctcactaaacttcatctttggcctttgtaccatgctcataaccattatgccccggttgctagccatcatctccaaagctaagaatttacagaatatctatgatgtcctcaagtgggtctttactatttttcctcaattctgtcttggtcaaggactggtagaactctgctataatcagatcaaatatgacctgacccacaacttcggcattgattcctatgtgagtccctttgagatgactttctgggctggatcttgcctcgtgccggcc

SEQ ID NO: 107509 - DNA, 421 bp, Homo sapiens
atgatttgggggtgaagataggccttgacctgagctgggtttggagggagaattattagtggcctgatggggtcttagactgagggtcgagtgtgttccttccttcctggctgggtgagcatctaagtcactgcctctcggaggctcacgtccataacagtaaagcagggatggtcttggccctcctggagggcttcctgcaagggtgttggtgaaatgtgtttctatttgtgaagctgtgctagtgctgttgccattttcatgagcagttaccaatcaacaaacacttgtagccagccctgcaccgggcccacgatcacccagggatgaagtggtgaccgaaagcaggaacaggccggagccttcaccagctaagaggtgagaccctcagctggggctgagacccagcctggctgtatct

SEQ ID NO: 107510 - DNA, 1116 bp, Homo sapiens
tacatcatcaattttcctttcttctgaattattcctattttccttttatctgaattatttctattaacataaaaaaattatttcttacatcttaaaatttttttttctccttattccacttcccccttctactacctcatttctctccttctcttagtagcaaaaccttaaaagagttgtttatacttgttccttctaagttccttcctcctgttctgagttaaaactattccactgaaatagttttagtcagggtcaccactgcctctaaatcctgtggtcagttcgtagtccacatcttatttaccatagcagcagcatttgacacaccatgacacattcttcagttgtctagggcacatagtcccctgattttcacacagactgctgcttctcaggctcctttgctgggttcctcatcatcatcctgaccttttaacattggagccactttggcattcttgacacttaaggggttggtggaggaagagcccaagattgaagtgagaagacaaagtaagagtcaggaggtcaacactgagataattatcctgtggaacaaaggggagagagttctaaggagataatcattagtgaattcacagcagcgaggttaagtaaagtgatgactaaaaagcgtccttgaatttgaccattaaaaggtcagtggcatccaccctgcattctattaagtcacaaaaaagtttcatgtgtattgtcatagccaaagaaacttaggattcaggtctggatgagatctctctctgtctgtctctgacgcgcatgtactctctctctctctttctctctctcctcttcttattttatggataaaggcgccaaggcccagagaagttatatgtcttctggtaatcacacagctagatataggcagagcaggaactagaactggtatctcaaaatcttcatccagtgttcagcccaccacttattgtaaatgcaatttcggaagtcttgattatctgatttttcagctgacagcagattagcagcatcaaattgggggtgtgataaaggcagtctcactgacagcagtaaaaagtgacagctgactgacagcttgacaacaggggaggagagagataaaccattttg

SEQ ID NO: 107511 - DNA, 787 bp, Homo sapiens
cacatggtgagggaggaaagcaaggagaggtcaggggaggtgccaggctgtttgtaatgaccagctgtcctgggaactagtagagtaagaactcattactataaggacagcaccatgccattcgtgcaggatcatccctatgacccaaacacctcctactagtcccgagctccaacactgggggtcgaatttcaacataaggtttggagagttaaatatccaaactatagcactacccttaatggcaactcaggctgatataaagtagcattccctgttttcttgaaaaattgacttcagagttggggattgcccatgctccctaattcccttcttttgagtgctcacatagcctgcttccgaattcttggtattttgctctctgtaaggtcatcattcaggtccaaagaagtctagaacaggatgaggtctcagtgggacctagaccaaggttcttgctcttcagaatcatcacagtagccatggactggactcttccatctcaggcactggctttgccatcatttttcagatgtagccttatcctgcccagaaagactcaacacctcaccaggggaagggatttcctacaaccaaaaccctactgcagttttcacttcttttttttttctttttgtttatatggtggatatttttactttatatagttttattcttatttttactgtttttcattgtttgtttttaaaagcttatcttattatagcttctttgtcccaggtttgcattactttcaattacaaaaataaagcatgattatttgaaa

SEQ ID NO: 107512 - DNA, 262 bp, Homo sapiens
tctacctggtccctgtaggatcagtttaagagtttacatttatttttccttacttggaactctcttgatgctgagtcagctaccaaggagtgtttggaagaagcatttataggtaaacatatattcattgttgccggggtcaatggataacagttgaagcaaacatagattaaccaaaagcttaggagaaagactggtaaatgggatgctttggggaataaggattttgaaaagatctaagacatttctgggaattgagaag

SEQ ID NO: 107513 - DNA, 2957 bp, Homo sapiens
ggcagggggagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaccg

SEQ ID NO: 107514 - DNA, 2779 bp, Homo sapiens
ggcagggggagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaccg

SEQ ID NO: 107515 - DNA, 2902 bp, Homo sapiens
ggcagggggagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcacttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaccg

SEQ ID NO: 107516 - DNA, 2887 bp, Homo sapiens
ggcagggggagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaccg

SEQ ID NO: 107517 - DNA, 3020 bp, Homo sapiens
cgccgccgcgcctcgaagtttgccggctgactcggaaagttgcgctcgggctcggccgccgcgtccggtccccgcgtccagcctccggcctgacccgctcgccgccgccgccgccctccacggggccccggcccagccaacccagcagccccgcctgccgggggcatgtgagccgtcgccgcccccgagaggccgtgcgggctgcaggggccccggtgcctccgaggcagcgcgtgggcgaggggtgcgcccgggccccagggccccaggcagcccggcttgccatgggcatccagggcatggagctgtgcgccatggccgtggtggtgctgctgttcatcgccgtcctcaagcagttcggcatcctggagcccatatccatggaagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaccg

SEQ ID NO: 107518 - DNA, 2559 bp, Homo sapiens
cagtgagctgaagcaagttttctgaggaagctatgtcatcaaaatttacaacatctgtttctttggaggtccttactgtaagtgaatcaaagtctactgattttggtctaaggggcagctgttcagaatctagctttagttttgatactggactgtgccccgcagcaggatggagaggccatccactttgaggactttgtggttggcctctccatcctgctgcggggcacagtccacgagaagctcaagtgggcctttaatctctacgacattaacaaggatggctacatcaccaaagaggagatgctggccatcatgaagtccatctatgacatgatgggccgccacacctaccccatcctgcgggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacacacagccattcatctgggctggcagaggggacagagttcagggaggggctgagtctggctaggggccgagtccaggagccccagccagcccttcccaggccagcgaggcgaggctgcctctgggtgagtggctgacagagcaggtctgcaggccaccagctgctggatgtcaccaagaaggggctcgagtgcccctgcaggggagggtccaatctccggtgtgagcccacctcgtcccgttctccattctgctttcttgccacacagtgggccggccccaggctcccctggtctcctccccgtagccactctctgcccactacctatgcttctagaaagcccctcacctcaggaccccagagggaccagctggggggcaggggggagagggggtaatggaggccaagcctgcagctttctggaaattcttccctgggggtcccaggatcccctgctactccactgacctggaagagctgggtaccaggccacccactgtggggcaagcctgagtggtgaggggccactgggccccattctccctccatggcaggaaggcgggggatttcaagtttagggattgggtcgtggtggagaatctgagggcactctctgccagctccacagggtgggatgagcctctccttgccccagtcctggttcagtgggaatgcagtgggtggggctgtacacaccctccagcacagactgttccctccaaggtcctcttaggtcccgggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcagccctagtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgccagcccaaagctggagccaatggtgagggctgagagggctgtggctgggtggtcagcagaaacccccaggaggagagagatgctgctcccgcctgattggggcctcacccagaaggaacccggtcccaggccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaaggccaaggcctcaggagagcatcaccaccacacccctgccggccttggccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaccg

SEQ ID NO: 107519 - DNA, 983 bp, Homo sapiens
ggcagggggagggcgagaagccgccgttgacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgagacaggctggagtgcagtggcaccaccatagctcattgcagcctcgacctcctggcctcaagtgatcctcctaccccagcctcccgagtacctgggactgcgggtgcatgccaccatgcccagctaatttttttattttaattgttgtagatgcaaggtctcactatgttgtccaggctagtcttgaaatcctggcctcaagcaattctcctgtctcagcctcccaaagtgctggaattgcaggtgtgagccaccacacctgggtgttgcttctttaaaatattttcattggccgggctcggtggctcacgcctgcaatcccagcactttgagaggccaaggcggtcagatcacctgaggtcaggagtttgagacaagcctggccaacatagcg

SEQ ID NO: 107520 - DNA, 554 bp, Homo sapiens
aatttttagtctctgttgtctgagagtatgtggtacatgtgagattaactgccccagaaaggatgcattgactaaagggatagtctggatgtgtcagggaaaatgtatattttctggtttgggcatttgactggatttcttgtctagttgtttttttgtttcatctaaatatgaaaatgcagcaaaagaatttaagagtcaaaaatcagtaaactctggatttttaacaggctagtgattgtagaggttcacgtgggtatctattgattgagggctacataccaattcacttgaaaatcccatattcttactgaccacccaggaaagactttggactttcaaagttaagagccattggtagaaagtcctttggctcaaatacaaacgagcatcttatatatgaactggataggaaacaattgctgttggatactgcaaacctgtaatatcaatagatacactgcatctctaaaatactatcgtttcagtcatttcctgttgtctttcatccagttcactttattcctttatgttacctatctggccactatagt

SEQ ID NO: 107521 - DNA, 509 bp, Homo sapiens
tggcaatatgcatttcaggttccttctgatcatttcatggcttgctagatcatttcttacaattgctgaatggtattgcattgtatgaatgtgccacaatttgtttaggcactcgcccattgaaggacatcttagttgcttccaaattttggtaatgatagataaagctgctaaacatttgcatacaagtttttgtgtggacataagttttcatttgggtaattaccagggagtgtaatttctacatcgtatggcatgtctatgtttagttttgttaagactacgcttagttttgcaacatttggcaaccctattttcattgagttgtacccctttttaagaggcaaagaacaagcatatacttcaatgagaaaaggctgtaaaggacatctgaaactcatgtgttcagtcattcatgcattcatttgatatttattgagcacagttatgtgcgagatcctggaagtacaaacatatgtaatggaaaagattcacgcacaaaccaaagc

SEQ ID NO: 107522 - DNA, 588 bp, Homo sapiens
cttataaatctgttgtgtttgactctggcacgacccctacaggttgtgtgactttgagtaagtttatataacctcttttagtcattcttttcccatccgtatgataagaacactaatgtctcttttgcaagtttgttataatgatcaaatgacattatatacacacacatataaaatatgtgtatatataaaatatatacatatatttttcaagtcattcaaacaatattgaaaactatgtgctaagcactattttaggtattagtgatatatcagttaataaaacagatttaaaagaaaatcttgccttcatgtaaattaccttttaggtaaatatatgaaagtacctgaaacagagtagccatttggtaactgctcttttctttttcctaagtaaaaggaaggcagtacttatccttcagtactgattttagcaggcagtacaatactggttaaaacttcatccggccaggcgcggggactcacgcctgtaatcccagcactttgggaggccgaggcgggcggatcacgagatcaggagatcgcgaccatcctggctaacacggtgaaaccccatctctactaaaa

SEQ ID NO: 107523 - DNA, 620 bp, Homo sapiens
ttagatttagctttaacgggtacttttgctggaagtgtaaaatattgacatttattgacataagaaaacctaaaatggaatcttgtagctactgtaaacctattttccaggtcagagaatatttttaagatactttatatgttaaagaggcctcattccttaacaagtactttaaaaattatatttggtagatacattttctttggtaaattttgtaatcaatgaagatgtaaagaacttcctttgatataattaacactgagctgtttatactcaaatacagcaaaccatattgatatcaattctgtaattggggatgagttgtccaattaagttcatttctttgaaaataaaaggatttctttattagccctacttccagatacacatttttaaaaagactcatttatactctaagctacacctaattccatttttttatcaaatcaatattaaacataatagcagacatctgaatatgccttaatttgtaaacatgattagcacaatttctaaaaatccagaagcaaaacatataccttacatttctgtactatgctgccagttatttcacatcattcccagctttctgctaatttctatcctgaattgtttgctct

SEQ ID NO: 107524 - DNA, 94 bp, Homo sapiens
ctgtgggattgtttctaagcacaaagcacagcttctcttctttgtataactgggtttttttaggtaagcccactccgccctatgcaagttccca

SEQ ID NO: 107525 - DNA, 338 bp, Homo sapiens
tgaatggtattgcctaggttttcttctagggtttttacggttaaggtctaacatttaatgtctgtaatccatcttgaattaatttattgtacaaggtgtaaggaagggttccagtttcagctttctacacacgcctagccagttttcccagcaccggctaactccctttatccaccattgaggcaatcactgttatctgtacaactgttcagacctctttttatgtatttatccatctacatgcagaaaagtaaaatgttttgagatttaaaacaatacacaggatactacacatattattctacaacttgctgtttttacccaacaagacatcctgg

SEQ ID NO: 107526 - DNA, 465 bp, Homo sapiens
ttcctatccccgacttttgcaaaaaaaaaaaagtactatttactgagtgcctgtaaatgttttatacactaaagatacatattactcatccttttaccctacaaatatgaatgaatattagagatgtttggcaacttgtccaagtcatacaataaatgactgaagtaggagcttaagtccacacagaacttcatacatgtaaactgagcagcaacttcacgcctagctccatgccactttcctagttttatttgtgtcttttttcttacatggttccaacttactttctgatattttactgtatgcaccttgtaaatgaattaaaatcttagttggaacaaagccaaatataaatgaaaaaataaaatttaaaatgttctggaagttgatgatggtctagctctattaggtttcataaaactaaaacaaaaaaaaagaagatcattatttcaggctggcacagtg

SEQ ID NO: 107527 - DNA, 411 bp, Homo sapiens
gtatttatttaatcttgtatctgtgatagggctctgagacacttctgtgaagcagatgtttgaagatctgacaattatggaagaaaatttctcatagaaaaagatatgttctccagccttgggcgggggcctgacattactcttccacatttcactcattcatttattgaaaaatgaaaaattatatatatttataatataccaggtgatattttgatatgtgaatacattgttgaattattatgttaagctaattaacatatctctcaccttacatacttattttttgttgatgagatggacatttcttttttaagtatgcttaaatgtgttcacggattgtgtgaaatttttggcatcccgtttcttgatataccaccttttgccacatttcttgtttatatagtatgt

SEQ ID NO: 107528 - DNA, 464 bp, Homo sapiens
gattatgcaacctcagtgttgcctttccttgtaaattatactgttgaagttcttttgtgtaaatagattgtattgatttttatctgagtgtatccgttattttcacagtacacacatctttaactatgccttgtcccttgagagtttacttgtgcattaagaaattaaggagggctggtcgcagtagcttatgcctatatgtaattccagcactttgggaggatggggcagaaggattgcttgagcccatgggttcgagaccagcctgggcaatatgatgaatccctgtctctacaaaaaatacaaaaattagccgggcatggtggtgcgtccctgtggtcccaactattaatattcgggaggctgaggtgggaggatcccttgagcccaggaagtagaggctgcagtaagccaagatcaagccactatacttcggcctgggggacagagcaagactctgtcaa

SEQ ID NO: 107529 - DNA, 399 bp, Homo sapiens
attattaatatgctcgaatttgggttcaccaatgaattgttttctgtttgttccctctatgttttgtttctgtttgccctttcttatcctctcttagataatttgaatactattttattttattttattttattttattttgagatggagtcttgttctgtcacccaggctggagtgcagtggcacagtctcagctcactgcaacctctgcctcttgggttcaagtgattctcctgccccagccgtccaggtagctgggactacaggcatgtaccaccatgcccagctaatatttgtatttttagtagtgacagggtttcaccatgttggccaggctggtctcaaaatcctgacctcaggtgatccgcccacctcatcttcccaaagtgctgggattac

SEQ ID NO: 107530 - DNA, 131 bp, Homo sapiens
gatacactagtaaagttatgcatcttttctcttttttgaagcagggtatcactctgtcacccaggctagcaggcagtgacatgatctcagctcactacactcaccaccctccaggatcaggtgatcctccc

SEQ ID NO: 107531 - DNA, 319 bp, Homo sapiens
  misc_feature (8)..(8): n is a, c, g, or t
tcgcgaangtgttatcctcgggtcccataccaagggatcccaggttgcttgctttcttctttaattcctccccaaccattcctatggattataaagagatatttcatgtataattgtttgcgtgggagcccgaggatgacttcagcttctcttttgaggtagagtacttttttgtagaggaggaatctgaggctctggtttaactggttggagagaatgccaggattcagcctgggtgtgaatccttctacccatcaaagagcgtcattctgctctctctggctgctccccacagcagaatggataacacgttcgcgag

SEQ ID NO: 107532 - DNA, 187 bp, Homo sapiens
cttgctttagtatatgttgagatgtttttgggttgcatgggtgactgtgtccagtaggcagatgaatctgtatatccagagatccgattggaaaaacagagccaacagtatggatgcaggggtcaccggccctaacagtggaagctgaattctttgagtgggtcaggaattagtgcagcactgtaag

SEQ ID NO: 107533 - DNA, 333 bp, Homo sapiens
aacacgctaaatgaaagaagcaagtcacaaaacctatatactgtgtgatcccatttattttaaatgtccagaataagtaaatctagagaggcagaagttagattagtggtttcctagagctgagtgtgggctggggtgggaagtgactactaagggtattttgggtgataaaaatattctaaatttagattatggtggtggttgcacaattattttaatatgctaaaaaccattgactagtacactaagtgagtgagctttatagagtatgtaaaatttatatctcagtaagttattaagaatcagcttattattctccaagttttgaaaaca

SEQ ID NO: 107534 - DNA, 384 bp, Homo sapiens
caggtgagactctgtctcaaaacaaaacaaaacgaaaaacttgttttaaattatgttctattttaatttcaaattagaaaaagtaaagaaaattacagcataatacatcctcatataatctttgcctggattcaccatttgttagcattctacaaatttgcattttttttctctctctttctgaaccatttgaaagtaagttgcaggcatcatgacatttcaccactaaatagttcagcgtgtttgtcctaagaacaagaacattctcctggccatgcatggtagctcacatctgtaatcccagcactttgggagctaaggcgggtggattgtttgagcccaggagtttgagactagcctgggaaacatagcaacaccctgtct

SEQ ID NO: 107535 - DNA, 1007 bp, Homo sapiens
tttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtgga

SEQ ID NO: 107536 - DNA, 1029 bp, Homo sapiens
tttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtggaaaaaacacacaaacaacaaaac

SEQ ID NO: 107537 - DNA, 874 bp, Homo sapiens
cagcttgtcaatttggtcttaaagtgtacagtggagtgacatgagtttcttctgcattggtgtggagatgggtactctccatcacatgaatatttcaaacaagggagagctcaaagtcttaagttgttgctcatggctaaggtaatgttgttctggaagtctttcaaagcaggatttattcacttcacagtcaagtcattaactcatggaaatgaggagcccaggaaaagaatatcattctgggctagtttctgttcctgtgcattacatgattttttaaattaatcatttgccagtggataaccattgatggtaaatttggcaagtatctttaaagttcttttttaagaaatgactttattaagttgtaatttcacataccatatagtttgcccatttaaagttcagtagtcttcagtatattcacagagctgcacaaccattatggttatcactgcactgctcctctagtccctcttcccctaccagtgcaaagcaaccattaatctactttatatctgtacatttccctattttggattttcatatacatgagtagaaacaggtactatgtagtcttttgttagtagcttctttgacttagcatattttcagtgttcatctatattgtagcatatgtcagtactttattcttttttgtggctgaatactatttcattgtatggatatgccatattttgttcatttattttctgatggacatttgggttgtttctaccttctgactattatgaataatgctgctataaacattcatatgcaagtttctgtgtggacttgtgttttcacttgtgtttggtatgtactaagtggagccaggcatgagctactgcacctggcagaggcaacatta

SEQ ID NO: 107538 - DNA, 891 bp, Homo sapiens
caagttttaagattctcaagccagtttatttaaatatagccaaaatatatacctaatttgtgttatataaccatcagcatttagcacaaagaattcattgaaatatatatccagagttctaggttgggaagatcttgggagaaataattcccaccaaaattccaggaactagaaaactgggacttactttcaccagccatgactctaatcttctcacccaccaggatgtgagactaaacactgcccgctctcctgtacccctcccatcccaaaccccagactacaaactccaaaagcatgttcatacaatcccttaggacaaggatggaaatagaggtgacaggggagaggaaggcaagaaacttagaagtgtctgaagggtgattttttaaaagtcgaggcactggggtgtgtccatggaattaagaggggtttcctgtcttagttctctcttgtatatgctgaaaaaccaaagcagagtgaggaacaaggactaggtggagaaagcaaggctgaacatggaagcttttctacagttacttctgtgaaagtaactataatttgaaactggattaaattttcccttccccttctccttctcattgctgtactagtattacaaaaagaagctgtgagaaacatctaaaagagttctttgcattgaggcagggtgataatggaccactggaaatgaggtgggaagtaacatcccaaaggggatggtaataactgagaaaataagaaagtatatttaatccttctactctactctgagttctttaacgacaggtttcacctcctgcccaactttgcacctttggtgcctggaaatctggcacacagtaggtggtcaataaatatgtcaaatgaatgaataaatataactgtagt

SEQ ID NO: 107539 - DNA, 400 bp, Homo sapiens
tgaagttcctcttttttgctcttaaatgggttgagagattgtgataggtagtggggggaaaaagcatttagggccctgaattttgtattatggtgtttttgctactagaaaacacatgtctcaatggtgaatatttttaaaaagttactatttcaatttaactagacccttaaaaataatagaggttcatcaacaagtggcataaagagaggaacaacaaacattggggcctacttgagaatgagggatgggagagggagaggatcagaaagaataactattgggcaccaggcttagtacctgggtgaaaaaataatctgtataacaagcccccacgacacaagtttacccatataacaaacctgcacatttacccttgaacctaaaataaaagttaaaa

SEQ ID NO: 107540 - DNA, 901 bp, Homo sapiens
ggcctcatcagccccacctgggacctggcaggggatgggtctgagcagccctagaggagggtccccagggcccacagcaagggtgacatgacccacaccatccccactgatgggacccacacagtgaacctcctcccacaccccctccccagccagccacttggaccagagagacgttatcaaagtgccctctcggaaacgtcgccttcatccaccatcctcttttaacccactgggcttggtcaggaagccgttggtcagcagggggcaggtggggttgggtggcacccttatgtcctgtgagaccctagcaggcactccagcttgggatttccagaggctctgaggtggctaagaacaggatgacaaatcgactccaaggttcaactcttcccctcatggacactcctccctatgctgttctcatctcaaattttacctgtttttctcaaagtagctcaccagaggttggaaatgagatcaaaggtcagcgtggatctcaacattattattcatcagggaaatgcaaatcacaccagagatgagacgccatgacactcacactagcagggctaaaatttaaaagtctagctggggctgggcatggtggctcatgcctgtgatcccagcactttaggaggccaaggcaggaggattgcttgaagcccaggagctcaagaccagcccggcacaaagcaaactgtacctctacaagaattttttttttaattggctagatgtggtacacatgcctgtggtcacagctacttgggaggctgaggagggaggatcacttgagtccacgagttcgaggcttggtgaactgtgatcatgccactgcactccagtctgggcaacagagtgggacctcatctcttaaaaataaagaaaaggaaaggag

SEQ ID NO: 107541 - DNA, 1020 bp, Homo sapiens
aaaagaggagcaaggacacgtcttacatgggtgcaggcaagagggtatgagcagaggaattcccttttataaaaccatcggatctcatgagacattcattatcaagagaacagcatggaaaaaaaacagcacccatgattcaattacatcccaccagatacctcccataacacatgaggattattacaattcaaggtgagatttgagtagggaaacagagacagaccatatcaccagccttcatgtttgtctttccctcttgaatgtgagaccaaaggggaaaggaccatgatatgttttgactgaacctctggcacctagagcaatgtcgtccgtatatgtttgctaaatgaatgactagatgcactgcttgaggattctaacaaaagataaacttagctaaataatctgcaaataatcatccttgattattttttctaaccttaaacatttgtattaattataataatatcacctcattatttgcttaccatttgccaggctatgttccatgcattttccacattttctctcacttaatgctcaaaactgtgtaggtacatactattaataaaattatttcacatacagaggaaccaatgcatagggaagttcattatcttgccaaggaagggaagtttaaaatgctaagttcgacattctcattccagagcctatgctctgggcctctacaatgcaatttccctcaaaaataaaccctccaggatgggtgggtggctcatgcctgtaatcctagcaatttgggagaccaaggtgggcacattgcttgagcctgggagctgaagacaagcctaggaaacacaaggagaccctgtctttacaagagatacaaatattagctggccatggtggcatgtgccagtaattgcagctactcgggaggctgagttggaagaatcatctgagcctgggaagtggaggctgcagtgagccaaggtcaaataactgcattccggcctgcacgacagaatgataccctgtatcagaaaaaaaaaaaaa

SEQ ID NO: 107542 - DNA, 285 bp, Homo sapiens
gaccccgctatgcccacagtttcattccatctgagttcctcgcagcattgggaatgttttggcccttgcagagatgcattgtaagggcagaactaaaaatagatgaatttttaattgcagaatttagcctatgcatactgtgccaggaacacagcagaagaaaacgattaaattcagagactataaaatcccagcctagatatgaagatcctgtttccaaagaggctcaaggtagtgattatcactgttaatgttggaatgatggtcgaggacccccagaaagag

SEQ ID NO: 107543 - DNA, 195 bp, Homo sapiens
tctgcttaatgttttatttttccagagacccgagccttaagccaaaggagtcatgccttaaaggaatttcagagatcagttaggggatgaagaaagtatttcctgaaatccttttcagtaccctggatatcaccccacccagataattgcttactcacccttttacaatgtcagccttgatgataactcagacga

SEQ ID NO: 107544 - DNA, 487 bp, Homo sapiens
tgtaaatttgtttaagttccttgtagatgctaaatattagacctttgtcagatggatagattgcaaaaattttcccccattccataggttgtctgttcactctgtggatagtttcttttgctgtcaaattattttcattcatattcttccattaaaaaaaggttcaaagttatgtcataaggcaatctatattacctttatatggttttagaatggaaggtaaataccacaatgagagttcttgttttaaataagtatgtgctgtaatattttagtataatatccgaaaataagatttaccaagcacaacatttttcaaatgactaggcttgatatatttgataaactgcaatttgtaattgattaaataaaccctgttggcctaagagttgctcaattctctcttttcttcatcagggttattaaggtattataagattgatgttatgaaaaaagatcctactcctaaaagaatttcaaacattta

SEQ ID NO: 107545 - DNA, 185 bp, Homo sapiens
aggtagggagagagtctgtatgacaaatattttccactgaagacttaacaaatattgcagaattccaagggatcttcctgagaagataagtgagcataactgttttgaatttcttcggttcaatcatggggaaagtgcttagtaactcctgatgcttacacttttttgagagagagagagtgtgt

SEQ ID NO: 107546 - DNA, 482 bp, Homo sapiens
ttctatgtgtacacccaaagaactgcaaatgtatgatcaaccaaaaatatgaacatgaacgctcatcgcggcacagttccgtaatagcccaaaaagtggaaacaaacccaaacgcccatcaagggttgaatggataaacaaaacgtggcccatccttacaacagcgtaaccttgggccgtacagaggagtgaagtatgatatgcaccacgatgcggaggaaacttgagaacatagtaagtgaaagaaaccagacacaaaggacccacacacggtgtgattccattcacaccagatgtccagagcaggagatctgtagaggcagaaaggagattgctggttgtctagggctgggtttcgggaggataagggagtgatagccaaaggctgcgagtttctttataaaggatgaaaatgtcctaaaattggggtgatggttgcatgtctgtgaacctactaaaaaccactgaatcacacacttact

SEQ ID NO: 107547 - DNA, 494 bp, Homo sapiens
gaatgaaacaagctattatcaaaatatttcagtctaaagcgttgggtggtttctggacttctacctgttttatattctcattttttcttcctattttttttatgattctgtgcatacaaagtattgccctggaggtgagacttaaaacattcaaaagaggttgaaaatattttattctgaaagtatatcccaactattctctcaggaaagcaggaatacgtggagcagaaaaacggacagctcaatcaaaaacagaacaacaaacaaagctcactttctttccatgattattccatctgggagagatgcctaggggttactaggatttagggaaaagagggaaagtaggacattttgttttcaaatatgtaaatgtctggcagttgccccaatgtttgaaggccaaaattgttatatttgtattattatattttgaagcagttgtattacaatttatttcacttcaggaggctcttaggaaatttgtatatttt

SEQ ID NO: 107548 - DNA, 407 bp, Homo sapiens
aagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggag

SEQ ID NO: 107549 - DNA, 779 bp, Homo sapiens
ggctttttcttaccaagccatcaaatgtggaatatagctttattctcgactctctgctgctcataagattctctccctgggtgaccttatacatgcccaaggctttatataccatctattagctgttaactccatttatatgagctcaaactttagctgaatttcacacttatgcatctaaacacctatctgacgttcgttcacagatacttcagagacatctcaaacggtagagagcgatagtaccaggcactgagctgtaatggatccgtcgttccagcccaatggtacgacctgtaatccgcatttgtacctttctctcgatagtcatcttatactgatttctaagccatagtatctcactaagtcagttgggggatgattctggggttcttaacctcacattaagttctattagttacaggattgaccaccgcttaatatctgtcttttccatgctccttccccctttctacttctgttcatgagacaactcagttttgagttcaaaaagagtacatgtgttgatgattcccacatccagacatgaggtgcttttcctaatacaaccatcagccatttcaattttggtttatctaaaacaaattcaccagcatctgttaaaccagctacttctcttagcttattgcttgtgtcagggtactacttttcttctagataccgggtgtaaacctttagcatgtaagttgacccctctctccattttgacagtcatttgtcaagctctggcctttatcccttgtagatggatgttgctt

SEQ ID NO: 107550 - DNA, 171 bp, Homo sapiens
ggggaaggtaaaaggggaattcggatttttataattcgaatttacaattttacaattgggtacagcttgttcactgtttggattatgggtacattagaagcccaaacctcactattatgtaatatatctatgtgataaacctgcacatgtgccccccaaatctaaaatctt

SEQ ID NO: 107551 - DNA, 289 bp, Homo sapiens
cctgtcccggtgccctgcggttgccatgccgacccccaggctgtgtttgcggatgttgtatttgatttcacacgtttggaactccgattacgtcatttcgcaacacagggttgccatgacagccggccccatgttccctgggtagctcacaccttgggggaaagggaggggcccgggcctctcccccaaccaaacctcaaccctgagccccctcggggagagaggccaggaatgtggggttgggaagcaccttgggatcaatcaacgtctacatttggggaaaccaagg

SEQ ID NO: 107552 - DNA, 404 bp, Homo sapiens
agagacaggggtctcagtatgttgcccaagctagcctcaaactcctgggctcaagcaatcctcccaactcagcctccccagtacccagaactacgacatgcaccaccatacccagcttgtatttgcttactatttattgatatccaccactcaatgtaagctccataaaggtaggcactttggttcactactgaatgaattcctgatacctagcacaatattaggtcataacagattcataacaaatacctgtgactgactaaattaatctttggccaaataaactgaatttttagaatttcaactatttgattatataaaatagggagatgacaataatctcttgctatacctgtgctcactctctctcacatacactccttattcattcatatcactctatc

SEQ ID NO: 107553 - DNA, 255 bp, Homo sapiens
tgggaaaatagctgtgggatgattttagaaaatcaaagctcaataacattatttattttcatcataaaaaatttgaaaatttgtaaaagaagaaaactttagaaaaattaaatttaacagtttaaatgagcaaatcatgatttgcaaatcgggtaacctatggatccagagtaggctcagagagactccaacacagccacatgttggtaaaatttttatgaaccagaaaagcaaaatgacatacagaaaatggaa

SEQ ID NO: 107554 - DNA, 766 bp, Homo sapiens
ggagtaaaagtctcattatgatatgaagttcttattccaacctcttggagaaagctgtttacagtgtgaaaatagcaactttttcttctggtttgtagtttgaatatctttggtcatgacattgggcagttgggtgaaccttttttgtggttcataaatcagacatgaggcttgtttcttaaaatttatccagtttcagccgggcaccagttgttcacacctgaaatcccagcactttcagaggccaaggctggcagatcacttgaggtcaggagttcaagactagcctggccaacaatgtgaaaccccgtctctactaaaaatacaaaagttagatgggtgtggtggtgtgtgcctgtagtctcagctactcgggaggctgaggcacgaaaatcatttgaacccgggaggtggaggttgcagtgaatcatgattgcaccactgcactccagcctggtcgagagagtgagactccatctcaaaaagaaaaattatctagtttcagctaataaagctttttaagccagctggagaattgtgaccaagtattggaggaaattagaagaattcagaatctagtccagtctacacgtagataacaagaactttaaaacaatgcacggggctacaaactgtaataagaataggtatattacagtttttctatagagacataactttttcttcccacattgatcacacaggaatctcagatttaaaaacctcctgagctaggaagccaaaccagggcagattttagatctta

SEQ ID NO: 107555 - DNA, 147 bp, Homo sapiens
aacaagtcatatttattctttttagtaaataaatttgttgaactgtggaaagagaaggtttgcttgttttaggtacctgggtaataatattacttcttagattattttttgatgagggaaaaatgaatggaataaacattccaagaa

SEQ ID NO: 107556 - DNA, 185 bp, Homo sapiens
ggacagatacattggcgatgaggtcgcagtctgtgcgacgtgacggaaacaaatccttacatcccaaagtgagtccccagcaggctttcctctctttggtggactgggtttttgtttctcaggtttcagatataaggcgtccaaataccactcgcggaattcttagcgtataccaaggtcagatg

SEQ ID NO: 107557 - DNA, 377 bp, Homo sapiens
catctcttgcccttccacaggataagctagtcgttcttcaaaatgtttcccattgtcaccttcattctagtattatttttgtactatatgtacatacactgttagtagcacattgtatatacctgtctttcctaccagatgtaaacacctttgcattccagatgcataacacatagatactcaaatatttattgaaatataattgatttatgctttaggcaactctattatgttcataagaactttagaaaaatttagattgacagaattttttaaatctccattaggttagttttttaatagagaatttggacttttaacttaattttttataggttattctaactaaaacctttttggttgtttacattcaagta

SEQ ID NO: 107558 - DNA, 310 bp, Homo sapiens
ctactccataggcagagcagctctgcaagattatatccaacaggaaaacaacacggcctcactgtgggtgccaaagcgagggcttgccaggcagaagacaacagcatgagcagaggcatggggcctgaagcagaactgtgtgttaggcgaacctgacacagggtggggagtgggtaccaggagagagttctggacaggttgtcacacagtgaaccgtggaaggtcacaacgagtacaggttttatcctgagggattttaagtggggaactgacatgatctggatttgtattcgaaaaatccccagcagct

SEQ ID NO: 107559 - DNA, 146 bp, Homo sapiens
aaatgggcttttaaggagtgatttgaacaagttggcaaacaaggaaaaaaggaatttcaccaaagaaatgtctgaaagaaggccatggaatgagactcaacagggaacagaaagaaagttaacccaaatggaaaggaagcccaacc

SEQ ID NO: 107560 - DNA, 214 bp, Homo sapiens
agccagagtatactgaattttgctagagggaaaggagtgggcttttagaaaatgtgcatttttcctaatgttaaattgatgtaaactataccatactgtagctggataggctactagggaagaaacagtgtaaagaaatgacccagcttcctcttctggaggtgacagaaagggctctggtccttgtatctatcaacaagttaggaagtggtct

SEQ ID NO: 107561 - DNA, 375 bp, Homo sapiens
gattagtttgcattgtctagaattttatataaatgaaataatatatacttcttttggtctggcttctttcactcagaatagttattctgagatttaacaatcttattgttgcatgtatcaataggccattcctttttattggtgggtagcgttccattgtgtgcacatagcagcttctttacccattcacccttttaatttagccattttagtaggtgagtaatggtatcccactgtagttttaatttgtgtttccctaataaccaatgatagtaagcatcttttcatgcggctatttgccatcagcttatcttctttggtgaaatgtctgttgaaattttatgagtttttttcatcgagatattttatttttga

SEQ ID NO: 107562 - DNA, 513 bp, Homo sapiens
ggcaacagaaagagaaagtagatctcaagtgacaggtatgctgaacattgtccaaatatttattttgaatttctcatttaggttcaaaagaagacccaaaatatccagctcataaaacgagtcacctttgacttcttgattctctcatccattaccactaattcctggctcttctgtaatttcctttgaacttatcaacactgcttttctttcaaggatttatccagcctacctaccgtttccagtcgagcctctgcttcatccttcacgatgtagccagagtcatcagacacgagtctgactatatcacctgtactaatggttctcctctatctgtaacagagacttgagagttttctccactcagaatcagaagtctgtgtatgttcaggcccacatatgttttattgataattatggtgaatcaagaaagaggtatagtatagtggttaaaagcataggctcttagtttccagaaatggaaatgcaaatgtctttaagtgtatgaaaaga

SEQ ID NO: 107563 - DNA, 537 bp, Homo sapiens
cacacataatagaaatttattttgaaaaataaatgttgaaacatttagtctcgcctttgttcacatatgaaattagcacgtcttcatttggcttcaccttaatattgcctctcctgtgtactttcctcactgcagaagaaccaacagcaaccatttctggggctgtaatttctggccttctgtaagcttttatgtcaagagagcttttagaaatcttttctttgtgagggcagtattaaaatttaaaaaatgtttttaagtttcttttaaacatattctcttgaagtcctttgcttttcatattgcccttgttcaagttcatacactgttaaatattctcttccctttgcttttcttcattttgtcaataaaagattttattttattttattttttatttttggcacagtctcgctctgtcacctaggctggagtgcagtggcacaatctcggctcactgcaacctctgccttcccaattcaagtgattctcgtgtcctccgcctaggcaacagactgagactcagtctaaaaaaaa

SEQ ID NO: 107564 - DNA, 102 bp, Homo sapiens
aaaccaagaaaagtttctaaggatcccatcatccttctaagaaggactagtaggtgacaaaatcatttatttttttttttgagacggagtcttgctctgttg

SEQ ID NO: 107565 - DNA, 1018 bp, Homo sapiens
aaaaaagagaaagaatataaagtgaatctgaatctccactcaaggggatggccccaaggatattgtagctggtaatttcttcatgccactaggtgtccccagtgttcaacctccatgactgagattggaagaagtagagttaaaagtttttactacctttgagaagcctgcgggcatgttcacagtcgtcccatgccagccaggttctgaggctaactgcttgtgcccctgctgcttcacatggcattgtgggagttgctgatactggggaaatgatggcagatctgaccaagtggtgctgagaaaaccaccctcggccttgcagactccatagtttatctcaaggcagtgccagtcggatttggtgctaaaggcataaggccaagtcagcctctgatattggcacaaaagaatggtctcatgccagtagcattgaactgctgagcttgggaaggcttaaggctcccacacacagactgagaatgatgggggtccctctgcgtctgctaattagacaaacattctatatctagtgccaaaagtggtcctaaatcctttggcaagggtcctttctgctctcatgctgatttgggggaggactgggcatcctgcctcaggagaacttgagtcctgaggaaagggccctagtaacacttaagggctacccctggctaacagatactcggctgtgggtgagagcagaaggtcttggacccctcgatgtgcaggtacttaattgtgtttccagtgcattttcatatacattatcccatttaacctttataacaggttcacagagtggatattcccattctgttgatgagaaaaagagtggagagactgtgtccagtgtcagcaggaagaaaaaagatctgttggaggccagtacatgttgacagaaactctagaccatattttgtctcctgtctttggccaaagagaactagcttcagtctgaaaagggcagggctaagtggttacaaggaactaaaaagttcaaggtaagacaaatgaggta

SEQ ID NO: 107566 - DNA, 340 bp, Homo sapiens
tccacttaagatatcatcgtgtatatgacaactgaattgtagatcagcagaaacaatttttcctgtatgttcaaagttttacaaagacttcaggctaacatcgccaatgcagccttgcacagcttcttcctaaaacaccaatgaagtcacatagaaagatgaaaacacaaagcagcagtgaaaattaagaaagacaacccactgacagtttgggggaagaattcctactaattgagtcctgaacaaaatgatcagtaccacatcaatgttccacctcctgcaacagaaagatgagaagggccgggcgcggtggctgacgcctgtaatcccagcactttgg

SEQ ID NO: 107567 - DNA, 713 bp, Homo sapiens
cacaggggttcatgcctgtatccccagcactttgggaggccgaggcaagtggatcacctgaggtcaggagttcaagaccagcctgaccaacatggagaaaccccatctctactaaaactaaatacaaaattagccaggcatggtggagcatgtctgtaatcccagctactcaggaggctgaggtaggagaatcacttgaacccgggaggcagatcgggccattgcactccagcctcggcaactaagagcgaaactccatctcaaaaacaattatttcaataatgcaatgcatcctaacacttcttattctttttcatttttctaaaaatgcttgtcataatccactaatgtgtttcacaatctactaaggggtcatgatctgcagattgaaaaatacttctttgggagatataaaaaatcatttaacctggtgttatgagtcaccattatgagcacattaactaactacactgtgctataaaacagtaatgcccttagggcctaagatatacagctataaacttacagtcaaaactcccaggccgggagtggtggctcacgcctgtaatcccggcactttgggaggcctaggcaggtggatcatctgaggtcaggagttcaagaccggcctggccaatatggcaaaaccccatctctactaaaaatacaaaaattatccgggtgtggtggcgggcacccgtaatcccagctac

SEQ ID NO: 107568 - DNA, 288 bp, Homo sapiens
acagcagggcactactggaacacagagaagggacatctacccacttttatgtcaatatcatgggctttctggtggaggagataacataggttgatacctgaaggacaaggaaaagcttcccagatagaggaaagaggcaaaggcaaagagcctgaggtgaggaagagccctgcagagttccactccatccagtttggtgctacgttattctagtttcatgaacctttactcttagaacttggtttattctctaatatctttgggattcagtgttgcagtgtgcttccg

SEQ ID NO: 107569 - DNA, 679 bp, Homo sapiens
acagcagggcactactggaacacagagaagggacatctacccacttttatgtcaatatcatgggctttctggtggaggagataacataggttgatacctgaaggacaaggaaaagcttcccagatagaggaaagaggcaaaggcaaagagcctgaggtgaggaagagccctgcagagttccactccatccagtttggtgctagagcaaagggcagagtgcagtaagtggtgagaaacaaggctgagtaacttggcaagaattacattgacatgggtgtttttatttcatggtgaaaaatttggaacttttcctgagaacaagtgtaagccaatgacacagtaaattagaggagatttaaaatgtcacctgtcaagtgactgcttatgaagggttattgctcagctaagtatttctgaatgagtcttagtctgttggccttcaatctctaccgaaaccctgagaacttgatgatgcttttgttttctgagaatcgtttcagtgtgctggctgacagttccatgaggatggcaaaacttaagaaactgtagagccagtgaaaaagagatgcacagacttcttgggaactgtttaagcttaggaacatgatgaatttatggtgcataagtacagtcttctctgtgaaagtttttgttttcacatctttcattagatgtgtgt

SEQ ID NO: 107570 - DNA, 438 bp, Homo sapiens
atgattgctcttgggggccagagggtgtatcctctgtgttacttaaattttaaacaactgagtaatttaggaccatcaggaagaaaaattaagagaggttaagagaagacatttgaatattccagtggaaatatatgctaatcggggattaattatcttccaagatcctcttactgctttctctcttttatctgttctctgccttttaactggtgaaagtaagggggcagaggagataggcatttcctgtttctctctctctctctctttctctgtctctctctgagatagtatcttactttctcaggctggagtgcagtgacgccatcatggctcactgagacctcaaactcctgggctcagataatcctcctgcttcagcttcctgagtagaagctacaggatcatgttaccgtttctggataatttttttttttt

SEQ ID NO: 107571 - DNA, 199 bp, Homo sapiens
tacaataattgttaatctgcctgtgctgctgaaaagagttgacctgggactgttacaaaataataacacataaaattaatcccacaaatatttgcagggcatataatacatatggaatactgtgttagtgtggccaagcatagtacagataacacaagtgcaacagctgccttaatgtttttgtagataaagatgaggg

SEQ ID NO: 107572 - DNA, 499 bp, Homo sapiens
catgcctcaccatcttttaattttttctacatttgaaaattttcttaataaaaaattgggaagaaaggggctttttaaaaagtcattacatgactcgtattgccagcaacatagtgaacttgatattctggagctattagatattcttgctagcatttcgtcgtaccactggtttgcaaatagagaaacctctaagactcttcttactcatttccttgaccaaaataaaactatgagtggaaaatggagtgatgagcagtaagcacactggaaaagtgggatgatcttgaagcaaattgctgataatcacttctgggattcagactgagacttgagcaagcttcaaggttggatgactgaattgaagacttccatgttaaattggttatcttgagaaggatacaagttaatttcaggtcagtaatgcttcctgacagttgtacaagcaaacacaaattacctctggagtaattcactctcagttaggcctccagaaatt

SEQ ID NO: 107573 - DNA, 636 bp, Homo sapiens
accatgacccctgctgactctgcttctgtggaaaccaataacttctctttcttcataaccccagtggtcactatttgaatgaagtgggattccaaacattttggcattcagtcttctgttttcagcccaggttggttttcattttttaaccacaggagatataaaagaatgatttagtaaatcataatagcagttaagtctgaagctgttcatcagcttctccttcacaagtttgggtatcagctcctcagtctcttttgctttcaccatttacaggcttcacttatttcttgagtctctgttaatttaagcttttaatgaaactgtgcatcttcctgaattacgtgtttgcactttcaaagttaaagtgtttctcaaatttcattggtctgtctcacagaatactgaattccctgacactttgatgatcctctcactttaaagcataaggaacatttggaactacttatctcatgcagtcatttctcggtttaatttctggctttagaagtttgtgtgcttcagcttgagataagtgtatttttaagagattgtgtattctgtgtaaaggtagcgccaactgcactgctttggaataggtatcattgctagactttttcattccatagaaagtta

SEQ ID NO: 107574 - DNA, 322 bp, Homo sapiens
atatctctgagagttgatgtttaagccaagattccaaggctgtacgggagttagccagacataggaaactgagcatccaggcagaagaacacccatcatatttgatgatctggtattcagaaagaatatagcatgtccaaggaactaagagatattcaaaatagctacagcatggaatgcaaatagaaaggtggtgagaaatttggctagagagataggaagagccagaatatgggaaatttttctagggtatgtcagggagtttatacttcatcaataggctctaagtaacgttaaagtatgtagcacaatgaatctaacc

SEQ ID NO: 107575 - DNA, 205 bp, Homo sapiens
gggatatatgagtcaaagataaaccctgtggctcacacttgtaatcccagtgctttggcaggccaacatgggagaatcgcttgaggccaagagtttgagaccagcctgagcaacatagtgagtgcccatctttacaaaaaagaattttttttaaattagctaggcattgcggtgtgtacctgtcctccaagctacttgggaagct

SEQ ID NO: 107576 - DNA, 408 bp, Homo sapiens
agacagagtctcactctgtcacccaggctggagtgtagtggcacaatctcggctcactgcaaccttgtctccctgattcaggcaattctccttcctcagccccctgagtagctgggtgcccaccatcacacccggctaatttttgtatttttagtagagacagggtttcaccatgttggccggggtggtcttgaactcctgacctcaagtaatccacctgccttggcctcccaaagtgctaggattacaggcgtgagccaccgtgcccagccccctcctgctattaatacaatgggagatggggctcagctctagtcagaggccatttcgtttcattggtctctggatttcacctctcttctgcttccctgaatcacgagttgctccttggctatagacacgttctag

SEQ ID NO: 107577 - DNA, 312 bp, Homo sapiens
ttttgcaaataaattgttgtgagttcactgacatcccagacatacgaatgtcactaaatctattgactacttaataagtaaggtataagtattaataatgtatatgtaccatcttttaaggtggaaggatgcagattatattttgagaattttttgtaattgtttccattaactatactttacacttctacaggctagcaagtctttgtctttttaagattattttgaacctctatttttgatagtaattcacttgatagtcacatgagacctgccggtaaaggccacagtgagccgtgattgcaccactgc

SEQ ID NO: 107578 - DNA, 799 bp, Homo sapiens
cctctctggaactcagcgggctgtgaggaagtcatgtatctaagaagcccaaacacatactccatggcccttgactgtctgaaaaactcagtttcggagtttaatacattcccccagggtaccaaataactagatttgtaaatgtaaattttttcagtcagttcttaaggtttgatgaggaacaggatatttacatagtcgcaaagtatctcaccacaaatcactttgcatttgtaataggaaaaattacgcagtggggaagttggaaaatacttaaccaaatgatgaaagtgaatatcacctacaaatatcatgtacctctggacatcatgccctcagaaggacacaaaattatttgcctagaattctagtcaaaaatgtgaaagatgaatctaagtatgacaaatatcaggcaaactcaaatggagggaaattctataaaataacttgcctgaactgtttaaaatgtcaccatcataaaagacaaaggaaaactcatgcctgtaatcccagcactttcaaagcccacggtgggaggatcactcgagcttaggagttcaagaccaacccgggcaacatagtgagacctcatctgtactaaaattcaaaaaaattagccaagcatggtagtgcacacctgtagtcccagctactccagggctgaggtgggaggatcacttgagcccaggaggtcgaggtggcagtgagccctcatcgcaccactgtactccagcccaggccacaagagcacgaccctgtctcaaaaaattataaaaattttaaaagccagacatggtgg

SEQ ID NO: 107579 - DNA, 677 bp, Homo sapiens
caacaaagtcaaaagtttaaaagagtaataaaatcgagaaacccatagcaatactgatcaagaaaagagagagattagtagggacattactccaggttctgtaggcttaaaagggtgatgaaggcctattatgaataactttatgccaatttgacaaacagacaaattccttgaaaaaaaaaaatactataacacaagaagaaaatgcattcatgtttagccttatgatccatttcaaattaagctttatgaatggtgtgaggtaggaatcaatgaaattgaattcatatttaaaaactcttcccatatataaggctccaactgacacattttcattagtgaattctaatcatatatttaaggaaaaaataatgcccaatgtaaacagactgtttcagaaaatagaagatgaaactcctcccaactcattttaggaggtgaacataaccctgatacaaaaagaaacaaaattgataggaatcctatcagagaagaaattacagaccaatgtccctcatgagtatagatgcaagtctctaacaaaatacttgcaaattaaatttagcaatataccaaaagtctaatacattataaccaagtgggattatcctaagaatacaaggctgattcaactttcaaacatcaaatgatgtaatttactatagtgacaaaatgac

SEQ ID NO: 107580 - DNA, 153 bp, Homo sapiens
cacaggcccactgtactttttcgttaacacttactgcacagaatgtagaaagactgtttacaaaatgactggtttaatgacagtctcctccaacacactgtaagtgcttaaaacgtaggtactatgtctacttaattgtttacctagcaccat

SEQ ID NO: 107581 - DNA, 236 bp, Homo sapiens
cctttcattccctcttcctttcccccgacctcccattcccgctccctcccccactcctcaggctgaggctgccacacttacctgggttcgactacagtctggtcataggcgtagccaggctctgccccttacaggataaaggccacagacccccatggggcccatcacaggtgtaagttacagaggggaagggtcctgaaagatgagactgggccaagaggagatgcagcggagca

SEQ ID NO: 107582 - DNA, 721 bp, Homo sapiens
gtgctgattaagtttccacattacctgcaggattataatgctttggcctactcctgagaactggtaacaggctacagtgagtgtagaaccaggaaatacaggacagcccactcctgctatacctcctatgcctgacccacaggcagatgtgctgagctagagacctagcgggtcacacaaacagttcggaaagttaagactagcatttaagcgcacacacacaaagaagtacacgcatgaacaggaagtatctaaaggacacttggaattgtttcaggtgcatacttgtaaatataccttatctgtgtactgggttgccgcataaaataagctgggtgcaaaaaggtttgaaagtcattgtactatcaataatgttcacagcaacactataaaatagcaattacttggcagcaacctaaatgttcctaaatagcagtctaagttgtggtaaagacaacaatggaatattaacaagaccacgaaaaggagtaaggtatagctacatgcaacaatatgttaattttaagaacataattacaagttttatgaagtatatttaaagcttgaaactatacaaaactacagctggggcaggagaatcacttgaacccaggagctggagggtaaggcaggagaatcacttgaacccaggttgcagtgagccgagacagtgccactgcactccagcctgggtgacaaagactctgtctcaaaaaaataa

SEQ ID NO: 107583 - DNA, 299 bp, Homo sapiens
aggaaatccacagcagcacattggcttgacttgctgggtcacctctagcacttcccttcagtcttcccttccctggtgttcttatcagtggatttaatcccatccagagaatgagctaggcattgactctctggaaaagacctctttaatagctcttttttttttttttttttttttttgggctatgttctcctcttccaattttaagtagatctgctttattctgatggtgccttctgttcagaggctccagcagacttacctgagtcctaacactatcactgtgatgggggtggtag

SEQ ID NO: 107584 - DNA, 248 bp, Homo sapiens
atgagagctgttttggtgtttcctccccaagtggggagatcaattagtgcaacaactctggcctgtctccatctcattacttggggcttccccagggaagggagtgactgaacttgcttgctgaatctgggcagaacaaatctggtttgcttagctgctttctacctgtctccttgggagtgagtttccccctaacccctacaggccatgcgactcccctctttctcttcattcctaagtcttaccta

SEQ ID NO: 107585 - DNA, 609 bp, Homo sapiens
ccttgggcagcctcgggggtggctgtggtgaaggttggtgggtgccctctgctcctgccctgacactgatggtgtggggtaatggctgcagcttgtgtttccgaggaagcctcttccagggatatttaggaggtagtgtttcttggggtgggtttctgttcctctcaaagggagagcagtgtcagaggttggtgtcaggtccaaagcagcagataatgtggtgatggttgtggtctttctgcagcctagtggcttttttttttggagatggagtctcgctctgtcgcccaggctggagtgcagtgacacgatctcagttcgctgcaacctccgcctcctgggttcaggcgattctcctgcctcagcctcccgagtagctgggattacaggcacgcaccaccacgcccggctaattttggtatttttactagaggtggggtgttcatcatgttggccaggatggtctcgatctcttgacctcgtgatctgcccacctcggcctcccaaagtgctgggattacgggtgtgagccactgcgcctggccagcctagtggcttttaactgctctgccgagacgcctggggacagtatggggacctggagaggcc

SEQ ID NO: 107586 - DNA, 238 bp, Homo sapiens
cacaaaccgggccgagggaccacttgacaccaaggccagtgggcggagctgcccgccagggggcctgacacttaggagggctcagtccccagagccgacagctcccatcctgcatgctctgggccacaggcacctagtgttggccaacttggccccatagctttctccagggctgctgcaatgcctcacccatgcagccaacagccctgccctccgctgtcggggagcctgccttgca

SEQ ID NO: 107587 - DNA, 464 bp, Homo sapiens
tcactgtgatgaccatgaggaaaacagactagaagagggagagtggagcatttggaagactatgacagcaatccagacatgaaattatcagaggcttggattagagcaagtctcaaaggagctcaagaataagtaaatagatttgagaggtaattaggcaggtcttaaagctacaatatgctgcatattagggtaagggagaagaaggtaacatgatttccaggtctctggcttctgtacttggaaagataatggggcaagcattgagatgagaaatcccagaagaggagcagtttaggacgcattaagtgtgatgctttgagatacccaagaagaaaagatgagaaggaagacatagcagcctagtgctcagagaaggctccagcctggagctattatttgtgcatagaggtggtcattaaagccatggatgcagggaagactacctgcaggggaaacaaagg

SEQ ID NO: 107588 - DNA, 456 bp, Homo sapiens
gtagaatgggcttcgtttggtaataaaggaaccagaaatagtttgaagtaaaattgggagatgattcatgtagatttactatattgttgtatcactttctagtgtgtagtactatgttatttaaaagagtaagtaggtaaaggagtggtatgattactttggatatttctgcttcagccacagttaccatgaataaatgatctgtctttataaaggagatggaagtgaattcaagatattgagatgttagatttgactgggttgtcctttggctagaagatcaccagataaaatgtaaacctcctaaactagatgagatgataccattaaacattttttttggcccagcactttgggaggctgaaatgggaagatcgcttgaacccaggagtgaggctgcagtaagctataatctgccatgcactccagcctgagcaacagagtgagaccctgact

SEQ ID NO: 107589 - DNA, 436 bp, Homo sapiens
attttgcgtgcacatctagattcatatatctgtattttaaaacttaaagctgatgttgagacagttttaatacaatggaggctgcacaaatgtccgcatttccctgggaagtgttcctgtttgcgggcaaaggagtggcaggacaagctctctagttaagaaacgaaaagcgctgtcattcaggggatctatcctgtgagccatctctcttcctctgcagggttgctagcaaactccactcataaacacagttaccagagaacaaatcccaatacaagttgcttactatgggtggacggccttattatgggatatttcctgtgaatgcaggaagaggaaggcattcttgtgacttcaagcaatatatatatacacacagttttctaaattctatgcacagtctctgccggagagcaatcttcctaatcagtccatg

SEQ ID NO: 107590 - DNA, 680 bp, Homo sapiens
gcccaggctggtctcgaactcccgagctcaagcagtctgtcagccttggcctcccaaagcgctgggattacaggtgtgagccaccatacccagcctccttttcattctttcaaacctggctgtgtcctcaaaacttccgcaggctcgtggctgaggtggggccgttcatgtgagcttagctcaccctcgcgcccaagtcgccagtgagcattcttcctcacttcttcatgtgggatttgctttcttccttattcttaagaatgggaagtgatggtttccaaaactgatacaaagtatcaactttaactgcctgtgatgtttcaatacaacacaaagtgcatatactgtttaccttttggaaaatagtcctgtttgttttgtgttttaaaaaatcctttagcttagaaaaccaactagggggtgaaattacatacaaaagttcctttatacagcaaagccaccgaacactgtgtaaactagctaatatgtttaaatattctggcaatattaagttatgttaaagaattatttaggatatatctattttgttctcattactaagctgggagttagaaattaaaactttatgaaacatttatagaataactatacaccctattcatggattactaattttcaaacaatttaatacaataaagtatactgaaaatttaaacttt

SEQ ID NO: 107591 - DNA, 629 bp, Homo sapiens
gaggacatagaaggtgccatctacaaagaggcagccctcaccagacacctgccagcaccttgatcttggacttaaccaagatccagaaatgggagaagtaactatttattgtttataagccactcagtttatggtatttgatgtttgttgtagcagcccaaacagacgaagacatggatggacccaatggctaggcttcctcaggtataggacagagaggagaaataacaaattataagaagatagtgctttatctaaatgtgtatgacattgctttcacaatctgatatcatgttatgaaagccagatgtgtgatttggagcaaagtttaaagaaataggaataatcaaaataatttttctttcaaaaatctaaatttcaacggctttcaaatatttcttaatctactcatgatttttgttgctctgcttcagtctcagcctttttctttttgatattttggctgccaaaaagcctgagtccttattctcaggagcctgattattatctccgataatggttctaaacttagtcatttttgtccatcattattattattagttttgaagtttaaagaatagcaaaatttggctctaaaaatgaaacagactttcatcaagtaatacttt

SEQ ID NO: 107592 - DNA, 446 bp, Homo sapiens
ccttccaccatgggatgagacagcatgaaggccctcatgtgccagatcctgtgccatgcttttggacttcacagccttcagaactataagcctaaaaaacttctagtgtttatacattagtcaatctgtggtattgttatagcatcagaaaacaaactaagacaactagtattgagaatatagaaagatttcctacaaataaataagaaaaagagcactctataatacagtgaataaaaaacttgagcaaacatttcacagatgagatatgaacaaccaataaacatttgaaaaggtgctcaaatttcttagaaattaggaaatacaaaataagtccacaacacttttatactcacttgtgttgtggaagtcaggaaccccaaactgagggactggctgaagccatggcagaagaacataaattgtgaagatttcatggacattta

SEQ ID NO: 107593 - DNA, 389 bp, Homo sapiens
atgaggtctcaccatgttggccgagctgctctcaaacgcctgacctcaaatgatccactcacttcggcctcccaaagttctgggattacagacgtgagccaccgtgcacggccgcgtttgcccctttccaagcaggttgggttggtatccagctgtgacccctgcccttgtagttctgagtcttgtctttgtcctccacgacaaactttttccatagccccaagcaacgtgcttcctagtgtgcatcacatgctcatgatgttgggaacctagtggctgaacatggtggtacttaatttcttaataaggactttctacattgggtagttggtttgttcatttttacatcatgctggttccagacaactaataatgcctgatattcaggg

SEQ ID NO: 107594 - DNA, 311 bp, Homo sapiens
cttatggtccagaaaacagacactagtgcagtgaataagacatgggtttggggttgctaatggttttgaatcactgcgcttcacttgttttcagggaggttatggtcggagttaagttcacaattcacatggccaagacaattcataatggaaagctgctagttgtccggagatcaattttcttttgggattgctctggaaagctctaaactcgcagtgaaatctgctgatgtgcatagctacaggcctaatttcaaggaagaagagtcacccatgaggggtttctcaccccgttctctggaaggactgag

SEQ ID NO: 107595 - DNA, 919 bp, Homo sapiens
ctcttatctcattgaatttcttccgtctgcctcatctgatcataacagaaagtgataagtttgataaaatgtatattgtacttactaaaaacaattttaattatttatcaatttaaaaatcagttgtttaaccttctctctgtctttccgttttctcatctaattcccaataatgttgccttttaatttctgctgccttgcggatcagcaccctgggattttttttttgtatttgtaaattaaatattgcgatgacaagatataataattttatgtcacttattagatttttaaccataaatgccgtaggcatgctataatatgtattccttacttttctttctagaactaaatctccatacccacttcatccgtgtttttggcttatgtatgggatgctagaatggcctatctccatgtattttgttgcatttctccattgcttcttgtgttctggcgggaatcttggtgattcttttcaagcactacctgagctctgtgccaattgttcctcttctcccagggtgttgtgctgcgtggtcatgtctccacttccttagccctgtccattgacagaaccttgggttctgtgatggctgcctctaaacccttgtgaaagcggggaatattcctccccctgctgctacagttgagcaccgtgctgggtaccatgttgccctctacacttgctttcagttgttaaggcttcccaagctttggctgtggctcagtgatcctgctgtcaaaaccctgaaactttcctagcctggacactcagtggtagcagcaggtgttgggatttctccaagcccctaagactctgggaggaagagaatggctgtttgacatagacctcaggagttttcaaagcaccaagaaacctctccagaagatatgtaaaggtaagattctgatttct

SEQ ID NO: 107596 - DNA, 568 bp, Homo sapiens
gcatgatacaatcgagctcggtcccagcagcatagatattaccggttgccccctaaaaacttgtagcaatttactcttaaatactcatggtgtgtaatacttattgttttagtacatcattgccaaaacttggttttatcaatctgttaactatgtgaaaaaggcatattaagattgttttaattttatatttcatgacaatttaacacttcatatttagctattataaaccgcctatattttcgttaggatacgttctttaacaatcttgcatgacttttggactttctgcttttatgtcttgcttaagtcttcctcactcaaagatcgaatgtattagaataatacatgtcagtatttttctggtagttttagtaagtcctgtcttccacacatactttttttgtcttaaattctgtattaagatttattttgacttaaaaactgggatacagattctgctttatctttttccaaatggctagccagttgttctaactggttttatgtacaggcaacaatggttttacttacaatttttcagttttacaatgaagcagaaatgatg

SEQ ID NO: 107597 - DNA, 6159 bp, Homo sapiens
  misc_feature (160)..(160): n is a, c, g, or t
  misc_feature (230)..(230): n is a, c, g, or t
  misc_feature (246)..(246): n is a, c, g, or t
  misc_feature (263)..(263): n is a, c, g, or t
  misc_feature (2373)..(2373): n is a, c, g, or t
  misc_feature (2384)..(2384): n is a, c, g, or t
cgacctctgtcaagggcctgtgggtccctgacccctgggtgagcgagggcactgctcccatgggcctgggcactgtgccatcctccagtgggaaacaggaggtccccagggtctgagagaaccatgcagtccaggtgtgaaaggggtcctacaaggtcanctgaccatagagaccttgggaccaccaggaaatcgtgggggccctcagccaggggatggggtcagggctncttgagcctgttccgnccatctagctccccttnaaccccagggaagaagtagctcaggtggagaccctgggtctgcatgggggtcacgtgagctgcctgtagccagcaggggggagggctgggtgctgtcctgaggatgcaggtgcaaatggccatttctgggccacctgtgtgtatcagcatctgcagaggggcctggggtctggctcctggggttggcagccccaggggctctgccatggctgcccaaggtggtgatatttcctgtctgcctgttgggtgtggggcagtgccaccctgtcccatcccacctcatcagcacagaatgaagctggtcctatactcatcacctgtgcacatgaggaaactgaggccccaagaggggagcccaaggtcatattactggggatctgtgggctggcgtctgagcccagcactgtggcttcaagcccacatctgccctaggagggcccaggaggccctgtgatgtcattcccccgtgatgtcattcccccatgacatcattcccctgtgatgtcatacatgtgacgtcattcccgtgctgtcaccacatgatgtcatcccctgtggtatcacctctgtgatgtcaatacctcttttaatgtcatccccatggtgtcattccccccatgatgccatccccccatgatgtcagtcccccatgatgtcaatttcccacaatgtcttcccctgtaatgtcaatactccctttgatgtcatccccgtaatgtcatcccctgtgatgtcattccctcatgatgccagtgtgatgtcatctctgtgatgtcattccgtgatgtcaccccccatgatgcaattcccctgcaatgtcatgcccctgtgatgtcatcccccggtgatgtcatccccccatgtgatgccagtctcccatgatgtcccccctgtgatgtcattcatgtgacatcatcccgtgatatcattcccgtgatgtctcccccatgatgtcattccccatgtgatgtcaatttcccacgatgtcacccctctgacatcatcctctgtgatgtctcgcccatgatgtcatcccccatggcgtcattcttggtcgtggggggttgtggatcccctcctctcccctcccttggggtcttcctggctggtggggagaggtggcctggcctgggtgccacagcagctgctctggaaggtgcccgggctcttgggggccttggcccacgccatcccctggactgtgcggcgccctccagggcccagcttctgttgggtgttgggcacaagtcagaatcaagtgcatctggccagatgctgccagggccaaggatgcagctgcctgtggcctggccttggtgtagagccagagtcttgagcaggggctgaggggacccagatggtggggaggctccggagcatgtgaccagggaccgtcctgctgtggacagacctcctgggctgagtgttggtcgggaccgggccatgcacctagagatgtcctttgaccagtggggagggtctgggggtgagtgtggctgtgtcccttggctactgggccagtgtagtccagggcactctagggactccctgtgttctgacttgaatggagctattggggctgaaggggcaatggccctgtgtctcctcggagcttgcaggtcctcttggaggcccagagagagccagaggagggcagggtcactgctgcctcctcatggtatggaattgactgagcccatgctgggatctggaggccccaaaggaatgaggcctgtggccaggggccggcccaggagctggggtggctttcgggggagaggcccgcagtgctgggaggtaagtggtgatgtgcttggcagcctcagtgctcccttaggagggtctaggaccccacctcgaatcttcctgggctatgcagagccaggaagagaggccaggtggccttggtgggtggcattagatgctccagccctgcctggaactcccttgggggtcgggccacagccaagaagagtgctgttttgcctgtgctaaggccactgtacgtgcagagctggacccagaacctcgtccaaggcccccggcagtctcaccaggaggtgtttagagctggccacgtggagtggcatacctccggggggcggggggnctgtgagaggncagtggtgtgggcccttggtctgtgcctcccacaggacagctgcttcaatagcatctgtgccccctcctgcctgtagtccacccaccactgacccctggacttggctggcggattttcacaccttctcctgggggcaggtctcagcttgtccccaacccagtcagagccagtctcactccctgcctcaggcaactgtgtatgttttaatttttatttatttatgtattcatgagatagagtctcactctgtctcccaggctggagtgtagtggcaccatttcggctcactgcaacctccgcctcccgggttcgagccattctcctgcctcagcctcctgagaagctgagattacaggcgctcgccaccatgcatggctaatttttgtatttttagtagagatggggtttcaccatgttggccaggctggtcatgaactcctaacctcaggtgacctgcctgcctcggccttccaaagtgctgggattacaggcatgagccaccgcctgtaattttaatttttaaccaaactgagaacttgaggattgaatgcaggtaacgggtggtgttcatgtggatgtggattccatgaaagagggctttgtcctcactgtcggttctccacatgtaggtcctttgactcagcaggccttaggcctagtccacaggtgctgagtgaacagccccagcgtctgacagctccttagcttggggtgcacaggcagctgaagcagtaggatggcagctcagacttcccagggccccacgtgtgcagggctggcctcccagcaccaccaggcagggccggcctcccagcgccaccaggcagggccctgtgagtgtcccctccctgacacacaccttgtagagaggctgggcctgggcaggctgctctgctgcaccacatcccattctcaagagggtcccaggtcccaaaggaagcctgtagcccagtggctttctggaggtttgcatggctggcaagcctgggccggctgctggagaggcatcaggacaggagcaactctgctgactgctcccctcagcgagctctaagagtctttgggtgggaggcacatcacatccctgtcactcctggctggccctggaatgcctcagcccacacaccccactccagccagggctgtgggaactgtgtctgctcaggtacaaaaggctttgtttgttcttggacctcttggttctggtctgggcttcccacctcccatgctgtgagcccccacgggctgggaccgcagcttgccatgtgtctctcagtggcaccaagtggacgctcgaggcttatgttgagggagtgagagccaggataggccactgggcgtgctgggagcccacacaggcagggagcccagcgggaggtgccctgctcctgccagccccggttaccccagcaggctcggcacccactcagagcccccatttctgctccccaggcactccctgtgtgcctacctgcccttgtccttgtcctgggccagcttggctcctgcctcccagctctgaggaggcctctgcaggtagccgacctccctggacgagggggcagctgcctcctctcacctgggctcaccctgagccaagtcctctcaacccaggataaatggcctttctgaaggcccagagagcatgcctgccccagtgtgggagctgcatccgctccccacctgacagtgatggccaagagcccagtgttcctggagggctcccaaactctggacctgtaggggggtcagggcagtcgctggtccctaagggaaaagcgtgaccctcggccccaggtggctgaacccgtcactgccagggcgagctgtcacctctgtgagctgataaggccttgcttttaggacctctaatctctgcaagaacccaagctggctctgcctgtttctcctgagcagctcgcagtgttcaccacactccagcacgactcgggacaggcacgtgcgcccctctgcaccagctggagtccctcaggacacctggctggagctgatgggcatgggcgggtgtgtgcgagcatgagcccgcaggtctgtgagcttcgtctccctttccttcttcgcagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacaggtgaggcgccccgccgcctgctgcatgccacacaggtgtgggttggggggctggcagccaggagtctgggggcagcaggctctgggcactgggcactgacagcgccggacagccgggctctggacaagctcccggtggacaggtggacacctcggtcgagaagacaggccggagactgagtggaaggaggggccgaggcagaccccaggtgcacacctgtgtggctctcacagcagccccgcccacctgtcctcgccaccctggcttcaccacccctgcaaggtggcatctcactgtggggctccagagcctcaagacagtcacggtctaaccagaaagtgggcaggtctcagggggcctgggagctaggggcctgcccctcggaccctggggcaagaagagcaccctgccgagtgaggtcctacctgcaggcagtcactgccccggccatgggcctctcaaggctggcacgaagccattcagggagagggctccacaacaagctgagggtgcccgactcaaactgtagaaccgggagtggacacccacagacgcccaggctggatgcgtgcgcaggcacactggatctcgtggctctctgggccgctgccaccgcctttgaacgtgtcggggagcaggagccaggccagagtctggcccagaggacagcgagaagcacctgttgatgctggggccactggaggaagctccatccctctactctcagcccgcaccaggcggccagctcagagcaccaggcgtggcgcaagcagggtggtcgtgggcagccagtcccgccctgctgcctggactgtgcccagcgggatgtgggcccgagcaggccagagaggccgagggcctggggtctctgcggcagccacagcccgtggtgagtagcagccttagctgtcctggagataccggggcctcgtggagtctaggcaggctggggcactgtggctgtggccgtggccaggtgagaagccccattcgcgcaggaaagactggccacctgggaacccacgcctccacggagggacttgccggccacaggctgtgggctgcccaagaggactgtgcaggcagggctgcctgctgattggcagctccggatcaggcccggtgcctgcagacctggtgctcccctcgggcagggctgggtgccgcagccgcctgctggcttttctggcagctcctctgtatcagaaccaataaagtgcacttgttctcggaaccgca

SEQ ID NO: 107598 - DNA, 1920 bp, Homo sapiens
gcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtactttctgttttgttcgaggggaaggcatggctgtgaatggacagcgtgggggctttggtttggcctgggggtcagagcctgccccgcccccatctgtgtgcccgcacacgtcccccgaggaaagactcagagacactgcctccccctacgctctgtcatggggtcttgagactgaggcttgggcaggaagatccaggtagggtcggggctgccctggccaaccggccgctcccagggagacaggactcagccaccagggctcagcaggcattttcggaaagcagggtgaaattgtctcttcccaggaaaaagattaaactccttgcaggctcttggataagttacacaaaaatagt

SEQ ID NO: 107599 - DNA, 1564 bp, Homo sapiens
gcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgta

SEQ ID NO: 107600 - DNA, 3058 bp, Homo sapiens
aagtggaaatggaccaagagaaaggattcttccacccaggagggtagaaaaggaggcgtccataggatgttcaggagtggagggacaaactcgggggtgtggctggcctcccagcaccaccaggcagggccggcctcccagcgccaccaggcagggccctgtgagtgtcccctccctgacacacaccttgtagagaggctgggcctgggcaggctgctctgctgcaccacatcccattctcaagagggtcccaggtcccaaaggaagcctgtagcccagtggctttctggaggtttgcatggctggcaagcctgggccggctgctggagaggcatcaggacaggagcaactctgctgactgctcccctcagcgagctctaagagtctttgggtgggaggcacatcacatccctgtcactcctggctggccctggaatgcctcagcccacacaccccactccagccagggctgtgggaactgtgtctgctcaggtacaaaaggctttgtttgttcttggacctcttggttctggtctgggcttcccacctcccatgctgtgagcccccacgggctgggaccgcagcttgccatgtgtctctcagtggcaccaagtggacgctcgaggcttatgttgagggagtgagagccaggataggccactgggcgtgctgggagcccacacaggcagggagcccagcgggaggtgccctgctcctgccagccccggttaccccagcaggctcggcacccactcagagcccccatttctgctccccaggcactccctgtgtgcctacctgcccttgtccttgtcctgggccagcttggctcctgcctcccagctctgaggaggcctctgcaggtagccgacctccctggacgagggggcagctgcctcctctcacctgggctcaccctgagccaagtcctctcaacccaggataaatggcctttctgaaggcccagagagcatgcctgccccagtgtgggagctgcatccgctccccacctgacagtgatggccaagagcccagtgttcctggagggctcccaaactctggacctgtaggggggtcagggcagtcgctggtccctaagggaaaagcgtgaccctcggccccaggtggctgaacccgtcactgccagggcgagctgtcacctctgtgagctgataaggccttgcttttaggacctctaatctctgcaagaacccaagctggctctgcctgtttctcctgagcagctcgcagtgttcaccacactccagcacgactcgggacaggcacgtgcgcccctctgcaccagctggagtccctcaggacacctggctggagctgatgggcatgggcgggtgtgtgcgagcatgagcccgcaggtctgtgagcttcgtctccctttccttcttcgcagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtactttctgttttgttcgaggggaaggcatggctgtgaatggacagcgtgggggctttggtttggcctgggggtcagagcctgccccgcccccatctgtgtgcccgcacacgtcccccgaggaaagactcagagacactgcctccccctacgctctgtcatggggtcttgagactgaggcttgggcaggaagatccaggtagggtcggggctgccctggccaaccggccgctcccagggagacaggactcagccaccagggctcagcaggcattttcggaaagcagggtgaaattgtctcttcccaggaaaaagattaaactccttgcaggctcttggataagttacacaaaaatagt

SEQ ID NO: 107601 - DNA, 1669 bp, Homo sapiens
ccctgggtgtgaaattcggacgtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtactttctgttttgttcgaggggaaggcatggctgtgaatggacagcgtgggggctttggtttggcctgggggtcagagcctgccccgcccccatctgtgtgcccgcacacgtcccccgaggaaagactcagagacactgcctccccctacgctctgtcatggggtcttgagactgaggcttgggcaggaagatccaggtagggtcggggctgccctggccaaccggccgctcccagggagacaggactcagccaccagggctcagcaggcattttcggaaagcagggtgaaattgtctcttcccaggaaaaagattaaactccttgcaggctcttggataagttacacaaaaatagt

SEQ ID NO: 107602 - DNA, 1588 bp, Homo sapiens
  misc_feature (1582)..(1582): n is a, c, g, or t
gcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtaaaaaaaaggatgacaatngaaata

SEQ ID NO: 107603 - DNA, 1963 bp, Homo sapiens
gcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacaggtgaggcgccccgccgcctgctgcatgccacacaggtgtgggttggggggctggcagccaggagtctgggggcagcaggctctgggcactgggcactgacagcgccggacagccgggctctggacaagctcccggtggacaggtggacacctcggtcgagaagacaggccggagactgagtggaaggaggggccgaggcagaccccaggtgcacacctgtgtggctctcacagcagccccgcccacctgtcctcgccaccctggcttcaccacccctgcaaggtggcatctcactgtggggctccagagcctcaagacagtcacggtctaaccagaaagtgggcaggtctcagggggcctgggagctaggggcctgcccctcggaccctggggcaagaagagcaccctgccgagtgaggtcctacctgcaggcagtcactgccccggccatgggcctctcaaggctggcacgaagccattcagggagagggctccacaacaagctgagggtgcccgactcaaactgtagaaccgggagtggacacccacagacgcccaggctggatgcgtgcgcaggcacactggatctcgtggctctctgggccgctgccaccgcctttgaacgtgtcggggagcaggagccaggccagagtctggcccagaggacagcgagaagcacctgttgatgctggggccactggaggaagctccatccctctactctcagcccgcaccaggcggccagctcagagcaccaggcgtggcgcaagcagggtggtcgtgggcagccagtcccgccctgctgcctggactgtgcccagcgggatgtgggcccgagcaggccagagaggccgagggcctggggtctctgcggcagccacagcccgtggtgagtagcagccttagctgtcctggagataccggggcctcgtggagtctaggcaggctggggcactgtggctgtggccgtggccaggtgagaagccccattcgcgcaggaaagactggccacctgggaacccacgcctccacggagggacttgccggccacaggctgtgggctgcccaagaggactgtgcaggcagggctgcctgctgattggcagctccggatcaggcccggtgcctgcagacctggtgctcccctcgggcagggctgggtgccgcagccgcctgctggcttttctggcagctcctctgtatcagaaccaataaagtgcacttgttctcggaaccgca

SEQ ID NO: 107604 - DNA, 1352 bp, Homo sapiens
gcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcgcgggggccttgctgacatcagacgggatatccgaatatctgatagcaattaaaaggcagccttgtttcgta

SEQ ID NO: 107605 - DNA, 1674 bp, Homo sapiens
gcgaaaacaagattgcggcgtgccgggtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgtactttctgttttgttcgaggggaaggcatggctgtgaatggacagcgtgggggctttggtttggcctgggggtcagagcctgccccgcccccatctgtgtgcccgcacacgtcccccgaggaaagactcagagacactgcctccccctacgctctgtcatggggtcttgagactgaggcttgggcaggaagatccaggtagggtcggggctgccctggccaaccggccgctcccagggagacaggactcagccaccagggctcagcaggcattttcggaaagcagggtgaaattgtctcttcccaggaaaaagattaaactccttgcaggctcttggataagttacacaaaaatagt

SEQ ID NO: 107606 - DNA, 1538 bp, Homo sapiens
gcggccgccgggcaggcggcggcggcggctctgggcgaggcggcggggcctgggctcccggacgaggcgggcttggcgggcgcccggcagctacagctgcaggaggcggccggcgaccccgacgcgccgcccaagaagcggctgcgggcagccgaggcggccgaggcggcggcggcggcggcggcggccggcagcgggaaactggaggagcggctctactcggtgctgtgctgcaccgtgtgcctggacctgcccaaggcctccgtgtaccagtgtactaatggtcacttgatgtgcgctggctgttttatccacctactagcagatgcccggctgaaggaggagcaggccacgtgccccaattgtcgttgtgagatcagtaagagcctctgctgccggaacctggccgtggagaaagccgtgagcgagctgccttcagagtgtggcttctgcctgcgccagtttccccgctccctcctggagaggcaccagaaagaggaatgccaggacagggtaacccagtgcaagtacaaacgcatcggctgcccatggcacggccccttccatgagctgacggtgcacgaggctgcgtgcgcccacccgaccaagacaggcagtgagctgatggagatcctggatgggatggaccagagccaccgcaaggagatgcagctgtacaacagcatcttcagcctgctcagcttcgagaagattggctacacagaggtccagttccggccgtaccgcacagacgacttcatcacgcgcctgtactatgagacgcccaggttcacagtgctgaaccagacgtgggtcctgaaggctcgagtcaacgactcggagcgtaaccccaacctgtcctgcaagcgtacgctctccttccagctcctcctcaagagcaaggtcacggcaccgctggagtgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggcctgtagatccaaagaccttgctcccactcatacctgcagttcacgctaatgaaatgaatggctagcagtgagccctttgttcccaggactttaaggcagactattaaaaattattgccaaaattaaga

SEQ ID NO: 107607 - DNA, 772 bp, Homo sapiens
gagatcacttacaactcgctgcagatcaagctgcggctcagcaaccggcctgtcttcatgctctctgagggcaggatggtctcggacatcaacaatgcctggggctgcctggagcagcaggaggaggactgctccttcctgctgctcaagggcccctacgacgacgtgaggatcagccccgtcatctaccactttgtcttcaccaacgagagcaacgagacggactacgtgccactgcccatcattgactccgtggagtgcaacaagctgctggctgccaagaacatcaacctgcggctcttcctgttccagatacagaagtagggcggggcctcaggatgtccgaggagcccacgggcggcatcccagcaccgctgccctgtccacctggctggcagctgcttcacaggactatctgatcactttagcaaaggaggagaacaaacgaagccaacacagggcaagtctgcatgcgtgcgcgacggggcccccgcctccggctcacccccccgacccctgcctcccctccttccgagggccgccagaggctgggctgacccgaagaggagacggtgcaccaggcgccccgaggctaagagacggtggcagcaaggaggccgagaggcacagcgaccctgccccagcccttctgtgcagtcaggcggcggtgctgctccatccctgcgggttccggcggggcgcgggggccttgctgacatcagacgggatatccgaatatctgatagcaattaaaaggcagccttgtttcgta

SEQ ID NO: 107608 - DNA, 330 bp, Homo sapiens
gtaccagggtgccctttcaaagtcctgggctgcactaccaggctgatgctttacctctagttggaaaatgtgaaaagtgattctcagccatggaaactgggtaacttccataacatctgctttgcttactggcctttaaaatgggagtagttttaggctgggcatggtggctcacgcctgtaatcccagctctctgggaggccgaggcaggcggatcacgaggtcaggagttcaagaccagcctggccaacatggtgaaaccccgtctctatcataaacgcaaaaattagctgggcgtggtagcgggcgcctgtaatcatagctactcag

SEQ ID NO: 107609 - DNA, 694 bp, Homo sapiens
ggagcagcaaggcgaacaattcaacgagagtggagtatgtgagggagagggcagtagcaggtaagagcagagaggtgacagggataaagatgttggctgattttccagggcctcgtaagccattgtaaggattcaggcatgttctaaacaggtctcaaaagtttattccaggaatgatattttctgtaaattgctcaattttctggtagaaaccagctcatgacagttattctaaagcctacatgatcacaagtatcatggtagaaaccaagatccagcagatctggtctcagatggtggagcaggacagcagcctgaaaccttccaagcaggtctgacaattgaccttctcatgatccaaacagattattgatttcttaaggcactaattatcatggaggttgggataaaaatctaatttccatttgcaacttcttatgggatgtatcaggataggctaggttattataacaacaataattcatggctcgaaaaatattgaagtgtttctctttctcatgtaacagttccaaggtgagtagcattttaggccaatgggtggttctgcttcacagagtcattcagggacccagactgacagcaactctccagagttgttctagttgtcaccattcccaccaacaggaggggaagaaagcatgcaagtccagactagggaatccctcttaagcaa

SEQ ID NO: 107610 - DNA, 223 bp, Homo sapiens
ttgatgggcttgccatctgagtttaagtggaaatgcagaatgttcccataccagcctgggttacattgtcctcttacaggggcctcaagcccagcagcgaactttggctcccgaattaggtagactgtctcggctggtatgtgacacagggcaaggcacttcattgcttcagagctccttccatgccgtaaaaggtcctacaagacctggtcctaatccctct

SEQ ID NO: 107611 - DNA, 733 bp, Homo sapiens
tgctgccttgttgaggtaggaggcctgtaggatttgttttcaggtcatggtcccactaatagaagcaggatttagtcaatcccgttttcagatgcagtgaagaagccagccaaaactaccaggtggggaggaaagcaacctctagttgccttcattgctcattagcataaagacactcccattggcgccaggacagtttacaagtgccatggcaacagcctagaagttatctcatatcgttctgaaaaccctctgcccctttttcagaaagttctgcataacctgcctcttacttagcatataattaaaagtccccaccagggattttgtgatcccatttatctaggctgttgcatatttcggatttgtttttcagagcatcatgcataaggtgattgctatgatgtatcacaggtagagatatatataggagggtgtacctccatttcttttggagtcagacatgtaacaacttaataaatgctaaaatatgaaggatataactgtcagaatgagataatgtgacaatatcttgaaggctataaagagctatggaaatgaaaattaaagtcaataaatgcaaaagaaatgcattgagcttttcactttgtgagaccagatcacaaatctgtatgaagattttcaattttaattattaccaagaggctttgtgcttattaaacatgtctttactaacaacctaaactctactctggtcttctgttgatgccag

SEQ ID NO: 107612 - DNA, 398 bp, Homo sapiens
tggaatatttgcatatacataatgggatatcttgggcatgggacccaagtctcaacataaaattcatttatgttccatacaccttacacacatagcctgaaggtaattttatataatatttttaataattttgtgcatgaaacaaagttttgactgtgactcatcacatgaggtcaggtgtgggattttccacttctgttatcatgtcagtgctaaaaaatttttagattttggggcattttggatttcagattttttgattagggatgctcaacttctacaatagacagaatagtttaagtttcctactgtggttttaattgagattttaaaattgagaatttatagtttaattggaaagaattaatgagattacctaagaatatagtatatatctc

SEQ ID NO: 107613 - DNA, 683 bp, Homo sapiens
ccagtagaattcgtcatcttccttacttgcttctccttccttgtcttccttttcttgatgcatatccttgccattcatctcactgggcgtcctgctgggctttgctttcccttatccctctgtcccttttccatattcaggtggtgattcagctttccgttttatgatacagtttatattgaaatacatgttcagatatggaggaactcttttgtaatgatgacattggaagaaaggcaagaatttatattgtataaaaattaagcatttattattagttttatgtggtttatatttcaggtaacataaattaagcttgaacagcacacaccgtctcgaaagacagttatttatttattttaactttatttttagttatttcattagctatttcattgagggtattctttcttctgattgctcgcttcgagaccataatgaacattcaagattgtgagatgtattcttattgtcccagattacattctatctgttgacagaatatatccctggatatcatgcttaaatgctgattagattctaaggcatcgtgacaaaaatttaattacagatttcggataaagaacttataagagtgagttgtgttcagaagtttatgaactagacagtgtgcatatatgaatttgtctattgtacttggaatttactatataaaacttaaa

SEQ ID NO: 107614 - DNA, 710 bp, Homo sapiens
gatgcagagtgtgggagtattttctgtaattctgtaggttgtctttttattcctatgatagttttctcttgctgtgcagaagctctttagtttaattaggtctcatttatcgtttttttttcttttgagacaaagtctcattttgtgaccccggctggggtgcagtggcacgatctcggctcactgcaacctctgcctcctgggttcaagcgattctcatgaatcagcctcccaagtagctgggataggtgtgcaccaccacacctggctaatttttgtatttttagtagagatggggtttcgccatgttggcaaggctcatctcaaactcctggcctcaagtgatctgcctgtctgggcctcccaaagtgctgggactacaggcgtgagctaccgcctcaatttttgttttggttgcagttgcttttgagagtatctctctttgcctatgaaatgattctatactaagaaaactctaaataatccgtaaggctcctagaactaataaacaacttcagtaaaatttcaggatacaaaatcagtgtacaaaaattagtaacatttctatacactaataacattgaacctgagggccaaatcaagagtgcaatcccagttacaatagccacaaaagagtaaaatacacctgaatacagctaaccaaggaggggaaagatctctattacagatactatgaaacactgctgaaa

SEQ ID NO: 107615 - DNA, 553 bp, Homo sapiens
atgagatgtagaaggtgtaggttgactttcgcttcccttctgctgcctctgttgagagcacacaatgctggaggtgtttggttcttctgcagcagggttcgtgaaagttgcagggtttagtcagtaaccacaagtcaagaaggaggccgtaaggcatgcatgttgctggtgcacgtggttctgtatgtggcatgattctggagctggcagtagtagtaatggcgtcctgattgtagcaacgataatggggtctggagccagaaatgtccaattcccaatgtttgtgatgtgtttcactacttatgaagcatattgatgtatcttgtaaattttagttttaaagcatcaccctgattctcagaggttagtggggcagatactaccttcattttatagatgtatggcagagatgagtggcaggcttggccacacagtagaatgtattaggaatgatgcataaagttctcctgactccatagttagggctctttcctcctcaagtactgcttttcggggttttgttttttttttttttttgagacagtctcgctct

SEQ ID NO: 107616 - DNA, 348 bp, Homo sapiens
aaatttaatgaatatacgttaaattaaaaactgctttcattaaactgagataatcttccctcaatgcatgaataccttcagaattcacatagaccaaagaattgtataaaatataatagccttaaaaatcttatttgtagctagcacagtggctcccacctgtaatcccagcacattggcaagccgaggtgggcagatcacctgaggtcaggagttcaagagcagcctggccaaactggtgaaaccccatctctactaaaaatagaaaaattagcagggtatggtagcacgtgcatgtagtatcagctactcgaggggctgaggcaggagaattgcttgaacccgaga

SEQ ID NO: 107617 - DNA, 160 bp, Homo sapiens
catgtcccagggagtaagtgggggcttccatgttgcatctgagaaggctccttttccagcagtcatacagctggtgtgggtgcaccacagtgctcaaatgctggacttctgaccccaaaccattgctaccacacttggggttaaagatgacccccaacct

SEQ ID NO: 107618 - DNA, 407 bp, Homo sapiens
cggggtctggggcctgggtgggagaagttggagctttcagttgtcaggggtttctttgggtccgagggacttgatccctttcccagtctaccttcttcttggtctactttttacgggattcgggattctgagatttagagcaaataagactttattttggaaggccgggcgcggtggctcttgtaatctcagtactttgggagagaccaaggagggcggatcacttgaggtcaggagttcgagaccagcctggccaacatggtgaaacctcgtctctactcaaaatacaaaaaaaaatcagccgagcgtggtggcgagcgcctgtggtcccagctactcgggaggctgaggcacgagaatcgcttgaacccgggaggtggaggttacagtgagccgagatcgcgaca

SEQ ID NO: 107619 - DNA, 353 bp, Homo sapiens
atataaaaaatgccacgaaattttccttttgagattcagccagggagacctcctggagtttagaggtacccagactggtgagtaaaaggagtgtgaccttgtgggggcagtcagaggacctagatgtctgacaccaacatccccaggttccagtctctgctcagttactactgggcctgagaagctgggtgcagagatagtgacccacccacctctgaaagtcactactttttgaagtcagaataccgcccatacattgtgggcctaagcaggttacgagggtctcggcagagacccagaggcatgctctagaaattgctgtgaccctggagcagaaacatgtggcagtcccc

SEQ ID NO: 107620 - DNA, 711 bp, Homo sapiens
ggattttggaactgcagttgaaggatcatgaaccatatcttggcttttaatctgttctttacttttgtcagaattgtcttcctcatactcacatggcatggcaccttcgttgtataaaaaccttcatggctttccactacttccctcttgaagcttcttttaagacctcccacatctgtgccctatcaatttttccaggcatttctctaaaatgtgtgtgcttcaccacagccaaactcaccttaccagaatttcctgagtgttccttctcctttgttcactgtgctacagactggaataccttctttcagaaacctccagtccacacttcactgcaatgccagggtcctaatcatcttcacgtgtctcaatttctacctttatgggagtcttactccagtcctcagacagaataagcttaagtactgcctgctcctctaaccagagcactaatttaacacattttccatgtggattgacattcatatgacaattccctgtcacccattagatttgaaaccctgcagcttctttcgctgtacttggcgtatagcatgtattccagagacatttgtcacacgaaggaatgcatgttttagttcatctctcttgttctcatcactctgacctcccacaggaatccttataaccctttgccattgcccttatcctgaccttgcccaagttgaagaacagagtctacgtctcaag

SEQ ID NO: 107621 - DNA, 365 bp, Homo sapiens
tgagatagaatctcactctgtcacccaggctggagtgcagtggcacaatctcggctcactgcaagctccgcctcctgggttcacgccattctcccgcctcagcctcccgagtagctgggaccacaggcgcctgccaccatgcccggctaattttttgtatttttttttttagtagagacgggtttcaccgtgttagccaggatggtctcaatctcctgacctcgtgatctgcccaccttggcctcccaaagtgctgggattacaggcgtgagccaccatgcccggccctttaagcatgtttctaaatggtcctgttcagttgtgttccatgtgcaacaacagagtaagtgggtgcaagtcctctg

SEQ ID NO: 107622 - DNA, 377 bp, Homo sapiens
ccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaag

SEQ ID NO: 107623 - DNA, 696 bp, Homo sapiens
gggcacatgaaaatgaaaaagttacagatcgtaggggccaatgtctaatagagggaaaatagaataatttattacctacaatgtggttatatgttatcagatatcaaatgattatcacatatgttaaaatgggataaatgcctcagagatataacaaagtacaatgtggattcaaagaagggtagtgattaataattaagtgaataatcacttctttcaatttgcagactgaccagacatcagtgttacacagacaaaaacatttcaattaatgttttaccttcatcctcctcttttgtttttggacctgatttgataacagaaaaaatgtgattatgattaagaggtagtataaaagcatgacctctggaaataagattcgaagctgagtttcaccatttactagctatgcaatcttgacaagttaactttgcttgcctgtacctaattttcttcatctgtaaaacaggattcataataatagtatctacttcctagtgttgtgctgtggtttgaaagaataaatcccacttaattttccatttcttacaggatttaattttttccccttggatcattttgaaatgcttagtacaaacattgacttcctgaaatgtaccacgtcttgtgtgtctgggccccaaatggatgtgggcttagtaattcctgggattctggaagacttcccttcctgaa

SEQ ID NO: 107624 - DNA, 438 bp, Homo sapiens
gctcttttgggctctcccagcactttaaaccagatagaatatacttactgattacagccggcgctcattctgagcacctgttagacactagcatatataacatcatcatgctgactctccacaagaatcctgggaaacaggaactatgattatatcctcttcacagatgaggaaactgaggctcagagggaaattgtcacttggccagtgagtagtggaactaggacttaatcctggggtcaactaatccagaacttcaggaaaaccggtgcagcccgtgccactagaccagggaaactgaccctaattaggggtgaataggaagttggcaagtcagtaggttcaggctggaagctgttgcttccttggcacccttagaactcccagccagactgcctatcccagctgctggaagtcagcaggggagggagaaagtgg

SEQ ID NO: 107625 - DNA, 461 bp, Homo sapiens
acaggatcttcggagccttaccctgagacagctgtgcctagcactgcaggcttcatcagaccacagagcacagcccctccatggaactgctgcagaatgttctgtctgaaaggtgaggggacttcgtgtccatttgggtggcaaaattctacttggggaagattgtcatttagcatcagagtctaaatcacagagctgattccagtaaaaatcaaagtttgagggagttttgtaagtatgaaagtgaaaaagtcattgttcttttttgttgcaaacaggaagaaagacctcctgctggggagatggaattctcttctagacagaaaggatatttctgtgtttgaatgtgttttgtgtgtgttttgttatagacaaaagtagctaaaagtttaaaagaaggtttttaaaatcaactcaataaatataggaatagtttacagcagtagtagagaaattttcat

SEQ ID NO: 107626 - DNA, 729 bp, Homo sapiens
ctagctcccaggtttgcttcctcacctctctccgtcttggtagaattgaagagagtttgtgccttgttctggattcggctttgacttaagggagtatggtggctggtgtgatctttcagaccacccagactttctccatatcaacaataagcctgtttcactttcttatcattcatgtgtttgctggagtagcacttgtaatttccttcaagatttttttaaattttttatttatttattttttttgcattcacagcttggcttcttggctcaaaagcactagttttcagcctatcttggctttcgacatgacttcttcactaagcttaatcatttctcacttttgatataaagtaagagatgggcagttcttccttttcacttgaacatttaatggccattgtagggttattaattggcctaactttaatattgtttctagcaactaggcttgaggagaataagagagatggggaggagccagtcctggagcagtcagaacacatacaatagtgatcaattggttcagtctgctgttttatatgggtgtggtttgtggtgcccctgaacaatataatagtaacatcaaagatcactgatcacagatccaccataacagatattataataatgaaaatgtttgaaatattgcaagaattaccaaaatgtgacacagacacaagaattgagcacatgctttttgaaaaatggcgctgataggcttgctcg

SEQ ID NO: 107627 - DNA, 332 bp, Homo sapiens
ttatacagcttcatatacactaaccttttctaacttaatgtttacgtgccatttattaaggtaaattaagaagttatttaattaagcatataacattttgaagagagggttaacattttctttcaagagcttacctctacctacacttgctcaagaggtagcattacagccaaaactctgaagacattggaatggcctgagatactccacttagctcaaacacaaaaactatctatttcccttatttattggctcaaaagacaaatatcatcttaaatatttcatcgtgttccacaagaaaatgaaagaggaagtaaccaatagtagaacag

SEQ ID NO: 107628 - DNA, 379 bp, Homo sapiens
gttttcagcctccactgtctgcagccaaccccaggggaggaatagtatggaagagaactcaaagaaatgaaagcacaacatacccctttactttgaaacaagaggcctgtaagtattcatgtaaaaagtcatggtaaaattctgtgttcttacagaatgatgatcctcttattttcaaagttgtggggaggcactcttatgggaataaaaagactccaaaaacaaaacaagaagaaaaagtatttttctacacagaaaaacttcaagaaaacatcccatcgccttttatgtcctaggcttttatccttattcttttaaaacacccattaaaaagaaagaggctggcgggtttcatgctaaaagctatttgctacagggg

SEQ ID NO: 107629 - DNA, 198 bp, Homo sapiens
gtacccagggctggcaggccccaggcgcagagcgtgcagacctccatttgcaggaaatacaaggaagatgctcatgtcaccaggaaaatcacagcaaatgcaccacgcttgctctgtgcccactctgtgcccagtaccttccttgattaactcatcggcctcccagcgccactgaggaaggacctgtgggtctccctt

SEQ ID NO: 107630 - DNA, 456 bp, Homo sapiens
aattgcttgagtccaggagttcaagccatcctccccatcttggtcttcgaaagcattgagattacccattcctctctcccattctgtgttttttgtttttgtttttgacaagaggtcacccaggctggagtgcagtggtgcgatctcagctcactgcaacctccacctcccaggtttaagcgattctcctgcctcagtctccggagtagcttattaaccaatacacttctgaataatacataggccaaagaaaaacactcaaaaccagcgctgggtgacagagtgagaccccacctcaaaaaagaaaaaaagactcgagaaattttgaaaatattttaaactaaatgaaaacgaaaaatacaacttatcaaaatttgtgggatgtagtaaaagcaatgctgcaagagaaacctgtagcattgaatgtatatattccaaagggagaaagatataaaa

SEQ ID NO: 107631 - DNA, 345 bp, Homo sapiens
tacaaattagtcaccctagcctacatagcaagaccccgtctctacaaaggataaaagaaacttacccaggtgtggtggtacatgcttgtgagtcctagcttctcagtctccggagtagcttattaaccaatacacttctgaataatacataggccaaagaaaaacactcaaaaccagcctaggaaacatagtgataccccatttctaaaaaaaataaaataaacaataataataaattagctgggcgtggcacacacttgtggtcccagctactcgggaggctgaggtgggaggatcacttgagtcccaggcagtcaaggctgcagtgagctattgtgatggtta

SEQ ID NO: 107632 - DNA, 200 bp, Homo sapiens
gttagatccccggcagaatccgcgcagtacagcctaggaaacatagtgataccccatttctaaaaaaaataaaataaacaataataataaattagctgggcgtggcacacacttgtggtcccagctactcgggaggctgaggtgggaggatcacttgagtcccaggcagtcaaggctgcagtgagctattgtgatggtta

SEQ ID NO: 107633 - DNA, 257 bp, Homo sapiens
ttttttttttctgagacagggtcttgttctgtcactgaggctggaatgcagtggtgtgatcacggctcactgcagcatcgacatcctgagttcaagcaatcctcccatgtagctggggccacaagtgtgcaccaccatgcccagctaattttttgaattgtttgtagagttgggggtctcgctatgtttcccagggtggtcttgaactcccgagctcaggctatcctgtagcctcagcctccctaaagtgctgggat

SEQ ID NO: 107634 - DNA, 283 bp, Homo sapiens
acagatttgttctaaaatcttctacttgacactcaagattctatgagatctaattgttcaacccacttttctgccactgtccctcagcctcagtagtaaccatttgatcacaacttaaggcgtttgatcaaacctaagcattctgggtttctgctttcctctgagccttgcttctgttccctctgcctgcaatgcccttcctcttatcactgccctactcttccaggcccaaatcaaataacaactcctccaagatttgtctccgtgagaatatctctgtcat

SEQ ID NO: 107635 - DNA, 372 bp, Homo sapiens
tagccacatgatttgggggtttgatttcttcccagtccgctgagtattatgatttatccattaaagcaggaaattcaagaataattgaataactaaaaaatggaggaaaaattatgttatatttttacatggagctttttattacaggtaaatagtaatcactaaaccatgtatactggcagctgggcatggtggctcactcctgtaatcccagcactttgggaggccaaggtgggcgattcatgaggtcaggagtttgagaccagctggccaatatagtgaaacaccgtctctactttaaaaattcaaaaattagcctggtgtggtggcatgcgtctgtaatccccgctactcaggaggctgaggcaggaa

SEQ ID NO: 107636 - DNA, 411 bp, Homo sapiens
acctggtacaaaatatgtgttcaataaatattcattgaattcagattaaataagactcattctgaaacatttggcagtatgacagtattaaaatataatttccaagttatcattgtgaattattttggtaatagcaatatttcagcttaatctgtatataggatatttataaagcaacttatattagtttttcaatagagatgtgtgaacttcattgagagcatctctggattattccaaacatttaaagaacatgcatatagctagatctttatgaaccagtggggaggcaaattactactactactattcctataacaacaacaaaaaaaatagtaatgttttataccagatatataattctgcagcactttggactcatccattgtgttctaatgtgaaaagtgactg

SEQ ID NO: 107637 - DNA, 287 bp, Homo sapiens
attcccaaggcacagctgcttgaggtgccaccaaggcccagctgggggatggggtgctgggagtgtgtcctggagcatgacccggcctggggtggtcagagaggcttctctcagggagatgctctggtgccgagaaggaagcggtgagtggagtcaggcaggtggggaggagggggaagggcagaccatgtggaagacatccatatggacgccctgagccaggaggggccttcacctccagaaacctcagtttctccattggcaaagtgggcgggattggcctcacc

SEQ ID NO: 107638 - DNA, 827 bp, Homo sapiens
gtggttcagggtgagtagcaagatgtgaagggagagtgctgagaaggaggagggtggaggaagttgagaaagacagcagctttcgatgagtgcacaggccactcttcaagtcaccaaatttaaatgttgcttgtgctgctcattaacatgttgggaaatccttgactctttcaggattccagctccctcatctgttaataaaatgagaaattgccacaaagacctccctgccttggaaattcaaagactatataggctctataattcaatggtagaacttttttatggggggtgttagttactaaaactgtagactgtttattttgacctttgagtataggaaaacttgttgaggtaaaaatattctcttctatgattattcaggtagaactttaccattcaacttagggattctgaaagatgattacagaaaagcactatgatgcagagctccatgtggtgatgtcaaatccaataattcagttaaactcctgtactgtttcattcttttgttggagttaaatactattgcaaacaaggctggatgtttttatttctttttgaaatccagaatgctctttgtcatttgacaatgcagcatactaaactacttaaaatactttgtgagtgaaatcacatgcatgaaatgtggtataagttactagagcccttgaagggcagcacttgggtttagttggcctcttctgttttacctaatttctcaatcccacctattcttttttctcactttcttaaatcccagtaattatcttaggcataaagcagttttctatgcatagacagttcatttagattggtaacatggg

SEQ ID NO: 107639 - DNA, 881 bp, Homo sapiens
gtggttcagggtgagtagcaagatgtgaagggagagtgctgagaaggaggagggtggaggaagttgagaaagacagcagctttcgatgagtgcacaggccactcttcaagtcaccaaatttaaatgttgcttgtgctgctcattaacatgttgggaaatccttgactctttcaggattccagctccctcatctgttaataaaatgagaaattgccacaaagacctccctgccttggaaattcaaagactatataggctctataattcaatggtagaacttttttatggggggtgttagttactaaaactgtagactgtttattttgacctttgagtataggaaaacttgttgaggtaaaaatattctcttctatgattattcaggtagaactttaccattcaacttagggattctgaaagatgattacagaaaagcactatgatgcagagctccatgtggtgatgtcaaatccaataattcagttaaactcctgtaaaaatttcccatctcctactggcagggtccaagtcaggatatactgcatttcttctgtttcattcttttgttggagttaaatactattgcaaacaaggctggatgtttttatttctttttgaaatccagaatgctctttgtcatttgacaatgcagcatactaaactacttaaaatactttgtgagtgaaatcacatgcatgaaatgtggtataagttactagagcccttgaagggcagcacttgggtttagttggcctcttctgttttacctaatttctcaatcccacctattcttttttctcactttcttaaatcccagtaattatcttaggcataaagcagttttctatgcatagacagttcatttagattggtaacatggg

SEQ ID NO: 107640 - DNA, 460 bp, Homo sapiens
gggcacttgcccgagccccttacccacgggctgcagggcagagtggatacagcactgggctgacacccctaccccgtctccagacaaccccagggcacagctttctatatccccagggcttacacagtgcccaccacctagcaggggatcagttaagtaactggaaacagaaaggaaggaaggaaaggaagaagagaggaaggtaatgatgggtgcaaagcagctttaggtgagtaagaaaaagtatttgattgatagaagcttaaattccttttattggatataattagagtcggtatcttggggtcttgatgggtccggatagcttgcacttgtctacaggtctggcaggagaggaaacagggagggaggctgagggggaaagagtacacactcccctgacccctgcctcgatctggatatttgagcacaagagagcagactgtgcccagagctccgg

SEQ ID NO: 107641 - DNA, 419 bp, Homo sapiens
ggtggaggttgcagtgagccgagattgcgccactgcactccagcctaggcaacagcgaggtcctctcaaaaaaaaaagaatagcttgtaagtttttttttgatgtttttgcccgattatatttgggattactagatctacagataaacatatatgtaaattttgctattatagggctaattcccctataagaattatgccattttatactaccagcctcacacacaaatatttagattttcttattctgataaatatgaaaggagatatggatattttaatttgcatttcttttatttatgtggttttttaatacatcataagcattttttcaggttgccacttgtcttaatatttaatagttgcttattcagtagatttaccataattagacaattatgcttattgagaattttagtt

SEQ ID NO: 107642 - DNA, 376 bp, Homo sapiens
tgccaagatccctttaagatgctgctcctcgtgttcgaggatgacactttaaacatccaggctttcaggtgatggtgtcatgtgatgtacgtgtctcaggctttcactcccacaggggaattcccatgcagcttttggagatgtgctgaccagtcacgattttttatcatagtagtttttccttgagggcttcacatagtcttctgaggtagcaggaagggagggagactttcttgccaacaccatttctaaatataaacttctaattaagcaggctgtttgaacctcctttggaaaggtcatttgtgaaagtggagcttttgctcattctgtaagcgattccccttcacttgcatcatatggacgatgccacgtg

SEQ ID NO: 107643 - DNA, 534 bp, Homo sapiens
gggattacagtcaaagggcttggaatagcatcccagttctacactctattttctatgtgatccttaacaaggcactatttcctaatctgtaaaatggaagatgatacttgctctgcatagctcaagggcttgttatgaaaatgaaatgtgataatacaaatactttacaaagtgttattcaaaatttttgttatgtgctaaatattggggatgccaaatatttagttatgacttcagaatgaccaaagttaatgggtttgaatggaagagactagaaaggctttgttgatgaggtgagtcttacatggagtttgaggtagacaaagatgtgatcagtggaaaaaaacaggaaacggaatcccaagtgcattgtttcagaactgggccagggtaaaatctacagattcactgggctatagtaaagctcatgagtgcctgtgtgctagccaggcagttattgaaggggcagttggtggtggacattaaactccatgattaggagctttaattgatctcagaggtaattaagcctca

SEQ ID NO: 107644 - DNA, 433 bp, Homo sapiens
tgaggcagcagaatcgcttgaacccaggaggcggaggttgtggtgagtggagattgcgccagtgcactctagcctgggccacagagcaagattccattaaaaaacaaaccaaccaccattaccacctttaggatctagcagctcttgctgttttactccagtgattgggaattaagcactgagaattgtctgttcaagtaacacatttctaactgtaaactaggcatggatcattggttgtaatatcatttacctttaagttaaaataacattttaccttaagcatcaggacttgtgatgcagctctagtggcagtcataatctacagctgtaggttttaaatcagtgattcttacagtatttcagaagcattgttacctataatatcctttgtgttttagggcagggtaaattgtcagctactgctaaaatg

SEQ ID NO: 107645 - DNA, 294 bp, Homo sapiens
gagagccaggaggctttgggggcagggatggcaaggctctgggagtctggtctgccggagagtgatacccagctggtccccaggggacaggccacccttggggaaaacaggtagagagggtttagaatgaatacccatttggcaagtatttctggagcacctgatggatgcgtgccaggcactgttccaggggatgcagcagaaacttgaccctcacaagtcgtgtgaggcaggcagtgcttattgtcctcgttttctagatgacacagccaaggcacagacatcttgggaaaa

SEQ ID NO: 107646 - DNA, 821 bp, Homo sapiens
gtctttgtaaactcttcctagaaattctgttcttttggctcctgtactggctctcattattttcttttcttcctagatgcttagctcacttgaattcaacgattctctctgttaggtgatcccatatctgtatttccagcctaggcctgtctcttgagcaccatgcatcccattcatgagggtgcccatgtatctgtatctgaatctgtctaccaaggtactctattcttgcattctctattttaagtaacagtaacactctgtaccttgcatcttctaatcaaaattaatttattgattgaaggtcattaccaatggacttatctcacagtctttttttttccccttaatttgagtacttatcagacaatgtgctaaatgctaatgcacaaaacatagaaaacgaagtcctaatcttcattaagcttccagcccatgattgcatgcatattgtgtgtctgtatgtgtgtgtatttggaaggtgcagaacagtaaagacaatgctctaatgcagtgtgattggtgctataataaaggtaaaattagactacacaaaagagttgctgaactctgaactcagataggaggaggggtagttagtggtgctggagaagcttcctaggggagacaaatggatcatttgtcctttctcccacaaaattttacctctttgaaccctttcttttgctaggagagctcttcccatctttctccctctacttcaatactccttatctctcagttccacaagtcttaactccaatatttcttccttgaaggtcttcccaatgtctacaggtagcaccagtcagatttctctc

SEQ ID NO: 107647 - DNA, 280 bp, Homo sapiens
ccataacatttctatacaactacaagtctatataacattcaagctgaaagccaaattaagaacacagtcctattcacaataacacacacacacacacacacacacacacacacacacacacacacagagacagagagagagagagagggagagagggagagagagcctatgaatacagctaactggggaggagaaagatctctataatgagaattacaaaacactgttgaaagaaatcagagatgacacaaacaagtagaaaaacattatatgctcatgg

SEQ ID NO: 107648 - DNA, 2538 bp, Homo sapiens
  misc_feature (1133)..(1133): n is a, c, g, or t
gttgccatgtttgctctgcccctggggtggaggccagaggagatgcttaccaggcctgagaccttgagagttcacccagggtttgtacgctgccacccagggttcccaaggtttctcccatctggtcagatgtcgaacacaaaatgtgggcattctgcacggaaggaaagatcaggcttctcttgctgagtgtgtgaagacagggagagccaggccccagcagatgcggcctagcacactctgatttggttttgtggggagggcccaggaacttgggggtggtcttggcattcagagctggtgctaaaaacccagagcagaagcagggagaagggagtgaggatgggacagagaagagcgaccactggggatcagaacagcttttcaggggccaccttgcagcctaaaataatgccgtttcagggcctgggcctgctgtgagagccagaatgaagcatgtgcaagattggaatgtgagaagaactgtggggggaaaccagttttaattaagtggaagtgctttgtgcttgtgctgaagttgcctgggcctcctgcagctctggacctcactggagcggccccgccctgcccttgcctgcctttcttttatgctgatgctggtgggctttttcctgcttcaggatccatgtaagggactgaccaggttcatccagccttaactggttcctgcaacccacttttaggtctcccaccaggggcctattgtgctgtcttcctgtgaccagcagatcctgtaagggggtgatcctaattctggggctctttgcagcaagaggagaacgttctttttcttgaacaaggtggccggttccctgggagaaggctgggaatggcacgtccggccagggcaggcggtgcggcatcctcctcctgggattcctgtggcctcccctgttctattcattgtttggcttcccacccataagctctgggatacccagggcttgcttcccagctcttctcatctccaagcctctgctccccttcccaccaccactgccatataaaatggccatgctaactcctacacaactaggagcctcagcaggattgctaggatgtgggttccttcctgcatgcttgcttctgcagctgtgtggccttgccatggncctcccaccactttcccttctaccttgccttccattgtcttccttctcccagaaagccaggtttcaccacgtgctcaccacaaactgtctcccctccctcgtaggagtcactgcagtagggcacctgcaggccctggtagagtgagcagggcttacgtgtacattctttctcactctaaggatgtgatatctgaccctgatgtcagagaggaggtctcaggactagcattcggggtcctttgagtgttcccagaatggtttggggtatcacacaaaacaccagagctgagggtagggatagagtccccaaacacacatcctgggagcaagccacttcatctgagcttcccataccaggagcatggtttgtgctttgatgggaaacctagcaagcccctgcactctggggcttctcctctcctggagcccagggcggctctggcccgatgatatggcagccataggtacaggtattgcaggtgcagcctttcttaagtaccctgcctccactctatagcccagctgctgctggagtccaggaccttagacccaggatgagcaaaaggatcccaccaggttgtccaggaccattgccagggtgaccccagagttcttcagacctgtgtctgatactgaatacagtgccatgggaccctgctccaatctaactgcctacaacctgcccgtccccctgctgcagggatgttgctgctacctcgggaggctctctgagactggtgtctggtcttagatgctgcacatagtacctggtgctagggtctaggggctgcccaaagcccagcaggaacagctactactcatcctgcagaggccttggcccagaccagctttccatccaaagcctcacctggtttccatgtccatctcaacagtctggccttcctgtgactgtagcctggcagccacaccctcagtaatcccgcacagtgagtccagcttctctgggagcttggccttcagttagcccagtccatgagagggcagggtaatgaggaggagtaaaggacctatcttctctgtccacataaggaagttgggaccacaaggtcttttatctccttgttactccccaaccccaccataacctcctactcagcacacagctttatcctggtagattataaggtgagcttccagaacctggcaggaggctggtgtatccccctgcacagagggaagtgtatctgaatgttgtgtatgtggctgatatggaagacatacatgtatgcaatccatcagcgtttaaagaagaagattggctccagttcggaggaggaggaggaagattacagatctattctgagtattttttagagagttaatatttatatttttagtaattttctggtagaaggaaattgcacaataaaatgatttggtttgg

SEQ ID NO: 107649 - DNA, 662 bp, Homo sapiens
gtgtctagaggatccgtactctgcaggatgagtagtagctgtcctgctgggcttgggcagccctagaccctagcaccaggtactatgtgcagcatctaagaccagctttccatccaaagcctcacctggtttccatgtccatctcaacagtctggccttcctgtgactgtagcctggcagccacaccctcagtaatcccgcacagtgagtccagcttctctgggagcttggccttcagttagcccagtccatgagagggcagggtaatgaggaggagtaaaggacctatcttctctgtccacataaggaagttgggaccacaaggtcttttatctccttgttactccccaaccccaccataacctcctactcagcacacagctttatcctggtagattataaggtgagcttccagaacctggcaggaggctggtgtatccccctgcacagagggaagtgtatctgaatgttgtgtatgtggctgatatggaagacatacatgtatgcaatccatcagcgtttaaagaagaagattggctccagttcggaggaggaggaggaagattacagatctattctgagtattttttagagagttaatatttatatttttagtaattttctggtagaaggaaattgcacaataaaatgatttggtttgg

SEQ ID NO: 107650 - DNA, 2593 bp, Homo sapiens
  misc_feature (1133)..(1133): n is a, c, g, or t
gttgccatgtttgctctgcccctggggtggaggccagaggagatgcttaccaggcctgagaccttgagagttcacccagggtttgtacgctgccacccagggttcccaaggtttctcccatctggtcagatgtcgaacacaaaatgtgggcattctgcacggaaggaaagatcaggcttctcttgctgagtgtgtgaagacagggagagccaggccccagcagatgcggcctagcacactctgatttggttttgtggggagggcccaggaacttgggggtggtcttggcattcagagctggtgctaaaaacccagagcagaagcagggagaagggagtgaggatgggacagagaagagcgaccactggggatcagaacagcttttcaggggccaccttgcagcctaaaataatgccgtttcagggcctgggcctgctgtgagagccagaatgaagcatgtgcaagattggaatgtgagaagaactgtggggggaaaccagttttaattaagtggaagtgctttgtgcttgtgctgaagttgcctgggcctcctgcagctctggacctcactggagcggccccgccctgcccttgcctgcctttcttttatgctgatgctggtgggctttttcctgcttcaggatccatgtaagggactgaccaggttcatccagccttaactggttcctgcaacccacttttaggtctcccaccaggggcctattgtgctgtcttcctgtgaccagcagatcctgtaagggggtgatcctaattctggggctctttgcagcaagaggagaacgttctttttcttgaacaaggtggccggttccctgggagaaggctgggaatggcacgtccggccagggcaggcggtgcggcatcctcctcctgggattcctgtggcctcccctgttctattcattgtttggcttcccacccataagctctgggatacccagggcttgcttcccagctcttctcatctccaagcctctgctccccttcccaccaccactgccatataaaatggccatgctaactcctacacaactaggagcctcagcaggattgctaggatgtgggttccttcctgcatgcttgcttctgcagctgtgtggccttgccatggncctcccaccactttcccttctaccttgccttccattgtcttccttctcccagaaagccaggtttcaccacgtgctcaccacaaactgtctcccctccctcgtaggagtcactgcagtagggcacctgcaggccctggtagagtgagcagggcttacgtgtacattctttctcactctaaggatgtgatatctgaccctgatgtcagagaggaggtctcaggactagcattcggggtcctttgagtgttcccagaatggtttggggtatcacacaaaacaccagagctgagggtagggatagagtccccaaacacacatcctgggagcaagccacttcatctgagcttcccataccaggagcatggtttgtgctttgatgggaaacctagcaagcccctgcactctggggcttctcctctcctggagcccagggcggctctggcccgatgatatggcagccataggtacaggtattgcaggtgcagcctttcttaagtaccctgcctccactctatagcccagctgctgctggagtccaggaccttagacccaggatgagcaaaaggatcccaccaggttgtccaggaccattgccagggtgaccccagagttcttcagacctgtgtctgatactgaatacagtgccatgggaccctgctccaatctaactgcctacaacctgcccgtccccctgctgcagggatgttgctgctacctcgggaggctctctgagactggtgtctggtcttagatgctgcacatagtacctggtgctagggtctaggggctgcccaaagcccagcaggaacagctactactcatcctgcagaggccttggcccagaccagctttccatccaaagcctcacctggtttccatgtccatctcaacagtctggccttcctgtgactgtagcctggcagccacaccctcagtaatcccgcacagtgagtccagcttctctgggagcttggccttcagttagcccagtccatgagagggcagggtaatgaggaggagtaaaggacctatcttctctgtccacataaggaagttgggaccacaaggtcttttatctccttgttactccccaaccccaccataacctcctactcagcacacagctttatcctggtagattataaggtgagcttccagaacctggcaggaggctggtgtatccccctgcacagagggaagtgtatctgaatgttgtgtatgtggctgatatggaagacatacatgtatgcaatccatcagcgtttaaagaagaagattggctccagttcggaggaggaggaggaagattacagatctattctgagtattttttagagagttaatatttatatttttagtaattttctggtagaaggaaattgcacaataaaatgatttggtttggaaaaaaaaaataataaagtcgtacggccgtgaatttagtagtagtaggcggccgc

SEQ ID NO: 107651 - DNA, 2620 bp, Homo sapiens
  misc_feature (1133)..(1133): n is a, c, g, or t
gttgccatgtttgctctgcccctggggtggaggccagaggagatgcttaccaggcctgagaccttgagagttcacccagggtttgtacgctgccacccagggttcccaaggtttctcccatctggtcagatgtcgaacacaaaatgtgggcattctgcacggaaggaaagatcaggcttctcttgctgagtgtgtgaagacagggagagccaggccccagcagatgcggcctagcacactctgatttggttttgtggggagggcccaggaacttgggggtggtcttggcattcagagctggtgctaaaaacccagagcagaagcagggagaagggagtgaggatgggacagagaagagcgaccactggggatcagaacagcttttcaggggccaccttgcagcctaaaataatgccgtttcagggcctgggcctgctgtgagagccagaatgaagcatgtgcaagattggaatgtgagaagaactgtggggggaaaccagttttaattaagtggaagtgctttgtgcttgtgctgaagttgcctgggcctcctgcagctctggacctcactggagcggccccgccctgcccttgcctgcctttcttttatgctgatgctggtgggctttttcctgcttcaggatccatgtaagggactgaccaggttcatccagccttaactggttcctgcaacccacttttaggtctcccaccaggggcctattgtgctgtcttcctgtgaccagcagatcctgtaagggggtgatcctaattctggggctctttgcagcaagaggagaacgttctttttcttgaacaaggtggccggttccctgggagaaggctgggaatggcacgtccggccagggcaggcggtgcggcatcctcctcctgggattcctgtggcctcccctgttctattcattgtttggcttcccacccataagctctgggatacccagggcttgcttcccagctcttctcatctccaagcctctgctccccttcccaccaccactgccatataaaatggccatgctaactcctacacaactaggagcctcagcaggattgctaggatgtgggttccttcctgcatgcttgcttctgcagctgtgtggccttgccatggncctcccaccactttcccttctaccttgccttccattgtcttccttctcccagaaagccaggtttcaccacgtgctcaccacaaactgtctcccctccctcgtaggagtcactgcagtagggcacctgcaggccctggtagagtgagcagggcttacgtgtacattctttctcactctaaggatgtgatatctgaccctgatgtcagagaggaggtctcaggactagcattcggggtcctttgagtgttcccagaatggtttggggtatcacacaaaacaccagagctgagggtagggatagagtccccaaacacacatcctgggagcaagccacttcatctgagcttcccataccaggagcatggtttgtgctttgatgggaaacctagcaagcccctgcactctggggcttctcctctcctggagcccagggcggctctggcccgatgatatggcagccataggtacaggtattgcaggtgcagcctttcttaagtaccctgcctccactctatagcccagctgctgctggagtccaggaccttagacccaggatgagcaaaaggatcccaccaggttgtccaggaccattgccagggtgaccccagagttcttcagacctgtgtctgatactgaatacagtgccatgggaccctgctccaatctaactgcctacaacctgcccgtccccctgctgcagggatgttgctgctacctcgggaggctctctgagactggtgtctggtcttagatgctgcacatagtacctggtgctagggtctaggggctgcccaaagcccagcaggaacagctactactcatcctgcagaggccttggcccagaccagctttccatccaaagcctcacctggtttccatgtccatctcaacagtctggccttcctgtgactgtagcctggcagccacaccctcagtaatcccgcacagtgagtccagcttctctgggagcttggccttcagttagcccagtccatgagagggcagggtaatgaggaggagtaaaggacctatcttctctgtccacataaggaagttgggaccacaaggtcttttatctccttgttactccccaaccccaccataacctcctactcagcacacagctttatcctggtagattataaggtgagcttccagaacctggcaggaggctggtgtatccccctgcacagagggaagtgtatctgaatgttgtgtatgtggctgatatggaagacatacatgtatgcaatccatcagcgtttaaagaagaagattggctctggagaaactggctctgagcgggagaaactggctctgagcgggagaaactggctctgagcgggagaaactggctctgagcgggagaaactggctctgagcgggagaaactgggctccgagcgggagaaactggctctgagcgggagaaactggctctgagcgggagaaactggctctgagcgggagaaactggctctgagcggg

SEQ ID NO: 107652 - DNA, 816 bp, Homo sapiens
ggcgtacggccggagtgtgggatcgctggctcttcgcacgcggcatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 107653 - DNA, 582 bp, Homo sapiens
caccaggcctgtccttgggtccagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 107654 - DNA, 975 bp, Homo sapiens
ggcgtacggccggagtgtgggatcgctggctcttcgcacgcggcatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaaaaaaaaaaacaaaaaacaactacaaacaaacaacaacaacaaaaaaagacagaaacaacaaaaaaaggcgccgataacttaggaggcaagtcacattaagaggcctgataaaaacaaggtacggagaaactttcccttgtggaaaccccaaaggaaatt

SEQ ID NO: 107655 - DNA, 465 bp, Homo sapiens
ccatgccttcccctccccaacccaggggctggcctggagcacctgctctctgcagcccaggccaactggggacctcacccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 107656 - DNA, 392 bp, Homo sapiens
  misc_feature (9)..(9): n is a, c, g, or t
cgcatcgantacatcgcaggcctagactcccgaggcttcctctttggcccctcctattccctggagtacgggaaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 107657 - DNA, 782 bp, Homo sapiens
cctggcccctggggattcccatgctgccgagtcactcctgtcacttaccctgacaggcctagactcccgaggcttcctctttggcccctccctggcccaggagcttggactgggctgcgtgctcatccgaaagcgggggaagctgccaggccccactctgtgggcctcctattccctggagtacgggaagaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacagccaggtaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtgtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 107658 - DNA, 663 bp, Homo sapiens
ggcgtacggccggagtgtgggatcgctggctcttcgcacgcggcatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggttcagcgcctctcctggggctggaagtgccaaagcctggggcaaagctgtgtttcagccacactgaacccaattacacacagcgggagaacgcagtaaacagctttcccacaa

SEQ ID NO: 107659 - DNA, 507 bp, Homo sapiens
ggcgtacggccggagtgtgggatcgctggctcttcgcacgcggcatggccgactccgagctgcagctggttgagcagcggatccgcagcttccccgacttccccaccccaggcgtggtattcagggacatctcgcccgtcctgaaggaccccgcctccttccgcgccgccatcggcctcctggcgcgacacctgaaggcgacccacgggggccgcatcgactacatcgcaggcctagactcccgaggcttcctctttggcccctccctggcccaggagcttggactgggctgcgtgctcatccgaaagcgggggaagctgccaggccccactctgtgggcctcctattccctggagtacgggaaggctgagctggagattcagaaagacgccctggagccaggacagagggtggtcgtcgtggatgatctgctggccactggtgtatgagtgaccacagggcctcccagcaccagcatctccgctttggaaaggtaccggctatctt

SEQ ID NO: 107660 - DNA, 154 bp, Homo sapiens
attgagtactcactggattctagagctgttttcagcattgtaactgggcagcgaggttggacctcgtgctggctggctgcagggcttggagaggaggaccccctcccctgccgcggttttgccccgcttcctccttcacaaatgcagtcctcaa

SEQ ID NO: 107661 - DNA, 172 bp, Homo sapiens
ataccacaagacagtcattaatttccaaatgaacaaccagagagtgagttctacagacattcagagcatcctataagccaggaagactcactagaagaaaaaaagatgtgaactggtcttcaagaatgggtaggaactgaatagagagagaggaaaggagaaggattcacca

SEQ ID NO: 107662 - DNA, 328 bp, Homo sapiens
aggaaaaaggagtcggggacgtcagtcacctctatcacccaggcaggagatgctgggcctggaaccagaggcaccccaaagaagccaggcataatatggcctcacctgagcccggtgacctcatctgcaaaactgggactcaagaatcagaaaacggtgaccttctacctctctacacgtacatatatgttttctaaagaagttaatcacaagaatccacaaacccattggttctgacctccaagagcctatatgataccctcctccacaggtagcccttttcctggcttctgttcttaccaaggccaccccacaactagtcatcccg

SEQ ID NO: 107663 - DNA, 410 bp, Homo sapiens
ccctctaaatgactgcagtagcctcctaactgatccccaaactctggtcttttccttctccttttgtcctatagattttcccccagagtatcatatttgggcacatctctgatcatgtcatttctctactcagtaacctaaaataacttaataagtctaactgcttattagagcatctaagactttcagttatctgatcccatcctacaaatctagccttaattccctcttcttccctttgtattgacgcatcctataatattgtcaaactggacacttaattcttccccaatctcttacttccatgaacggctcatcctgtctcacctccctctccctgcacatattcctttcctacccatctttcattgccaaggacaaatgccatccctgatccctcctgacctttc

SEQ ID NO: 107664 - DNA, 209 bp, Homo sapiens
accggcgcaaggggcggatcggctaaggggagagagcccgggagccctgcacaaatgcggaactgcgacggatggcagcaaacccgcagggaagggatggttatttaataaatgctgccagaaattccagcccaggtgggaaaagaaagaaataagttccctgtttcacacctaacacaaaagtacataccgactggaggcgggcttaa

SEQ ID NO: 107665 - DNA, 344 bp, Homo sapiens
gcaggtgaggaaattcaggcccgtgctgttaaattacttgcccaaggtcacaggtctttgctagtggcaaagccaaaaccgaaacgggagactcttgaattcttagaagcctcattcaccaagagaaggttaactgtgtctcatgaaccctatatgggaaaattggggtgtgtaggacacattttagatttccttcaggagtggttaccttttttaaaaatgcacacataaagaagtgtcctttaaacagttggctgtgggggtaatgacttattcccaaagatacaaaataagcaaggctactttggatgttaaatgaacagggaattatttaaaaaaggaaa

SEQ ID NO: 107666 - DNA, 500 bp, Homo sapiens
cagagattctatgctcttaaccattatgtggtgctgtgtgatttagtgacaggtctagggtactttaaggtggctatgtagcatagctgggatttgaacctacgtcttctgactgtggtctaagattaaagttgtccaagtcattgcctttgtgatctagaccacctgttgcacaggtgcatgaatagtttgcatttgatataggctaaggttcagttccaaaaaactcccttttttcttaattttttcattgtttagagtggtgctgtccaatgatgtaggtactgtgtgtggttatgagcacttgagatgtggctagtgtaaatgaagaactaaattttaattaaatagatctgtgtagccgatggccaccatattggatgggcacacgtttggagaatttgaatagcctctgcttcttatatcagtttgtataaatttgggtggcatttctaatgtacttgagcttttatcagttaggatgacccattcttgctctc

SEQ ID NO: 107667 - DNA, 413 bp, Homo sapiens
ccacgcctttatctcccctcccagatggggtccccaaagcagagctggggctttgcttcctccctggccctccacggcctccagaaaacagcccacacctgtcagcactcaaggcccctggagacctgtgcctggctcttctttgccccatgatccctcctccctggaatagccttcctgaccctaggctgttcaattcccacttgtcctccagggacccattagaacatcacctccaccaggaagccctccctggtcctgtgtctgggctcacggcctccctgggctctatcagaattctcatccccttgcattatacattataatgggctattgattcatcatttcttgaggtcagggatggtgggtcctcagggagagatttttaagtgagggaaggaaacaagtaaagg

SEQ ID NO: 107668 - DNA, 691 bp, Homo sapiens
tgtatatatatgtatataaatttcccagaaaaatactgaaccttcctacatgtgatatatttggatatttcctattctaatttatgtatttaaaaagctgctgtgactcactgatggctaacagccagtagtgagaaaaaacactgaactaaaacgcgtgagcacctagaacagtgactgatcacttagcaaacgcagagttaagagtagtgattgtttttaaaccaagagagaaagttgactaaatacacaatttcagtaaggacagcattatctttattgttattgctctagatgtatccagtaagtgagaggtaaaaagtattcatctgcaatctgatggtcagtggtaagctgctagagaaatttctgtaggtgggttggggtagtggattaagaaataaatgtgaaataaggaagtaagagtgagtttagtaaactcaagaagcttgagagaaaaagatagggccatttgctagaggattaagggtttttcttttctttcttgtccccttcctaccctccttctctctctttcttagactggagagactagactctgggaaagtttaagtgaataagagaagattgaagaagcagacgagattgataaattggggaatgggaaagagaatagagtctaaactctggtccataatgtcaacatttaggggtagattattaaaattgt

SEQ ID NO: 107669 - DNA, 759 bp, Homo sapiens
cagtgagccgagatcatgccactgcactccagcctgggcgacagagagagactccgtctcaaaacaaacaaacaagcaaacaaaaacacacatactctttgaccagcatctccagttcccagaatgtttcctgcagatatacgtgtgtgtggagaaccgctgtgcagcactgtctggaagggcgagagccgtttaggtgggttaccatgcagaacaaaacaagcacagcagctaagaagatgaagttttcatttgctgaggtacaccaatctccaagatatgttaagtaaagcaaagcagaatgaagaatgttcgtcgtaatggatccatctctactcaaagaaaagacacacaaatctaggcttgtctatgattattgaaaagggatgcatacaaattgggactcgtgtgtagtttctgtagagtggacggctgggtgcacaggctgcaggtctctcctgaatcttttgaaaggggttgaatgcgttgttgttcagcaggtgggtctttggaaggtggacagttgtgtgtgcacaacacagagcagggacagggacgtggggctggcggctctgggagctgagaacctttccagcaagcaagcagctggcctttggctgaaatgacttagtcaattaaaacaacttgtggtcttaaaaaataaaaaggccaggcatggtggttcacgcctctaatcccagcactttgggaggccaaggcaggtggatcacctgaggtcaggagttcaagaccagcctg

SEQ ID NO: 107670 - DNA, 556 bp, Homo sapiens
agtgaatctttggtaggaagacagttcctagctacctttttaacattttgtttgatatattcacacctttatttgactctccaaggtgttgagaacagacaagccatatattagcaattgaggaaagaggaacacctaagtgaaccctggctgtccagggctgctgaagcattagagtggttttcaaactttaacaggcgtaagaattatctggagggcttgttaaacagcttcctgggttccacccacccctagaatttctgattcagcaggtctgtgttggggcctgacagtttgcatttgcaacaagtttccaggtgatgctgctgctgctgctctggatctcacacttttgaggcactgatagaaagtaatgatcagtctctgcagtagaccaagtatgaattcataatgcttactataattcctgaatttattcttcccttataaacaaaaaaacccttaaaaggattatatagtagggctaacctggtttgctttagcctatgtgaaatcaaatgtaatttaagctttaattgcaaaacagctaataagt

SEQ ID NO: 107671 - DNA, 221 bp, Homo sapiens
caaaaaaaaacttccattctttatcttggactggtagactaattttaggtgtgaacatttaaaaatggtaatctgacataaaaaattctaagtatcattgacctacatgagggctctaaaatgtgatctaaaataatcacactcaagttaaaagcaacaattcctttagaattaaaatgctttattgttgaacattagcaatgaatggaaggaagaatgca

SEQ ID NO: 107672 - DNA, 751 bp, Homo sapiens
cagttgataaagcagtggtagagtttgagaggattgactacaattttgagagacactgtgctgtgggtaaaatgttacgaaacagcatctcatgctacagagaaacattttgtgaaaggaagagttaactgatacagcaaacttcactgcggtattatttaagaaacactacagccaccccaaactggacttctaagcagcacaggtgcctctgcactctctcgttattctccagggttctcccactgacactccagtcaaatcttagctatttatctgttgcctcggtctttttttgttgagagtggactagcaccaggcctctcttgtcagccatctttctgatgtcactcctaaacataacttttagaaaaccaaataccgcatgttctcacttacaagtggaagctaaatgatgagaatacatggccacatctggggaacaacacacactgggacttttcagagagtggaggctgggaggagggagaggatcagaaaaaacaaatgggtactaggcttaatacgtgggtgatgaaataatctgtaaaacaaacccccatgacacaagtttacctatgtaacaaatctgcacatgtacccctgaccttaaaagttaaaaagaaatttttaagaaaattgacgttgtgaaggcaaacaaacaaacataacttttatgtgcactgggaaaccaaaaaatttatgtgacttacattattgcgatattctcattattgcagtggtctggaac

SEQ ID NO: 107673 - DNA, 380 bp, Homo sapiens
gctaatattataaaactctcagacataaacataggtgagcccagtgccatgacacatgcctgtaatcccagctcctcagggggctgagggggaagctcccttgagtccaggaatttgagaccagcctgggcaacatagcaagactctgtctctaaaaaacaaaaaggagaaataaacatagatgtataaatcttcatagctgtggattgggtaatggattcttagatatgacatctaaagcacaagcaagctaagaaaaaatagttaaacttcatcaggccagccatggaggctcactcctgtaatcccaacacgttgggaggccaagacgagaagattgcttgagctcaggagtttgagaccagcctgggcaacatagc

SEQ ID NO: 107674 - DNA, 416 bp, Homo sapiens
ctaatgttacaacaaagaaaaattcaaggatagtaatcgagtctaattccattcacagaaaaacggaattcttgctttggctattcacatgaagttggttgcagtcccgggaacagcacagccacaatgaacttgtacatgctctgtaaaaatgctcagcctggtacccttgttgtggcacttctcacactctgaattgaattagtgttctccagtttccctaactttgctgttacaactcagagaatggacaccgtctaagtgctcacaggataggcatagtgtctggttcataatgggcattcgggaaatgtttattccttatttaaattaatgccttgataatcaaatccaagaatgaagaagtgaatgaggaaatgaattcctaagtatgtaaaatctgcattcctctggag

SEQ ID NO: 107675 - DNA, 484 bp, Homo sapiens
gcctcggcctccccaagtgttgcaattacaggtgtgagccaccgtgcccagcctaccacaggttattcctataaccaatatcctcacatcctcagagtgacacagcagaatgaattctgggaacacacgcttcttctttttttttttttttgtagctatcccagaaggggaaggaaaaagaaaaaactgcagtggacttggaaaacacactcttggctctgagtcctgatatcactgcttaatatcaatatgattcttgaaaaaagtcactgtgtttctaagcctcagatccttatttgtaatatagtgacaatcccacattaactccaaggtgattgtgaggaacaaaaaagaaaatgggggccaggtgcggtggctcacgcctgtgatcccagcactttgagaggcagaggagggtggatcacctgaggtcaggagttcgagaccagcctggtcaatacggcaaaaccctgtctctactaaa

SEQ ID NO: 107676 - DNA, 238 bp, Homo sapiens
cacacattgctgcaggttgttgatagtattaaaacatggtttgacctgggaaaaggccattagggaaaaaatgtgaaggatggaggtttgacacccacttctgtgcacacacacacatatacacacatacacacatacatagccacatgcatacacacacacacacacacacacacacacacaagatgtgcttgggctgtatgccttccttgagaacagcttggtttcattcgctaca

SEQ ID NO: 107677 - DNA, 801 bp, Homo sapiens
cctaaacaaactgaagcatgaacagaaaatcaaatactgcacgttctcacaggtgagagctaaatattgaggacatatggacacaaagaagggaataagacattggggcctaactgagagtggagaatgagacgagagtgaggattgaaaaactacatatcaggtattacgatgattatctaggtgtcagttttatctgtataccaaagccacatgatatgcaatttacccatgtaacaaacctacacatgtatcccttgagtaaaaaataaaagttggaaaaaaagaagaaaaatttaaaaatacaaaaataaagctgctattatgaaaatgatctaacaagcaattacaaatgctttgtaaacaaattaagaaatgaaaaatcttaacagtgaattggaagtttaaaaaaattcacctgaaaattacagagctgaaatatatgataataataacaaaactcacttgataaactcagtagtggagtgagaatgatagaagataaattaagtgaactcaagtcctgaacaaaaaaacttacctattctgaacagcaaggaggaaataaaaaataaacaaaggcccttgaaccaatgggacagtaacaaatgaattaacattaatatcattggaatcccaatgaacagtgaagcaagatcaaaatagtccttaaagaaataatagatgaaaacatgtcaaatttgtcaaatgagaatagccttcagaatcaagaagcagaacacacctaatatataacaaacaggacacatcataattaaaactctgaaaaataagccccta

SEQ ID NO: 107678 - DNA, 409 bp, Homo sapiens
ctcatgtaaccgtaaaatcagctatgctttttattaagtaacagcaactaggtagcaatcaacagcaatcttcttagaaaataattttatgctaccaactaaagttccaatttcacagcaatagagctaaagctaaagggaaaacctcaggaataagtggcctgaacatgaggaaaatgtaatagaagaaagcaaagaataagaggaaactggatctgagttatttatcgaagcacattaaagaacaagcgtgagccaccacacccggccgaattttggagcactttggatttcagatgttcagatttggggtgctcaacatgtactgtagaacttttttcagtttctctttctgtatctcatataaacattttactgatcttttactcagtgtaattttacacttttt

SEQ ID NO: 107679 - DNA, 268 bp, Homo sapiens
tgttaacgttcttactgttactatttagctttagaaatatacctggttctctgtcctgattctgccacttgctggcactgttaccttcaaagaatggggaaaagtgactttttccccattctgtgaagttaattgttgattagccagtagtataggaacatactccctgagctgaaaaatatttccggggaatccagatccagtactcttccgtggccatcacctgcaccccatccctctcttcaaaggtgacaaaggcacaaatgag

SEQ ID NO: 107680 - DNA, 147 bp, Homo sapiens
gtttatattgcctggatgcctgacttggaagttcatggtacagttcagggccttgaaacagggcagggcttgagccccaactgtgcacaaagcactgggctggatcttctgagacagaggagccttctctccccttcctgcctccag

SEQ ID NO: 107681 - DNA, 206 bp, Homo sapiens
aaggaattgtgcagagctgggtgctgtggctgagctaaggggtgaggtgggatgtgatatagaaccacggctgccaggagaaaaacagattgggggagctaggggtggaattcacatgtaatttgagccttcttgtgtttttccagaaaagattttttcccccataaactctcttagttggggcctaagtatttattcctaggtat

SEQ ID NO: 107682 - DNA, 263 bp, Homo sapiens
atctcctgacctcgtgatgatctgcctgcctcggcctcccaaagtgcgtgagccaccgcgcccagccataaattttaatgttctatttcatcacctagggatatattgctttacagaggaaaacaatatattgagcaatatgttatgaaaatgatttgacttaataatccagagctatttagtctcctacagtcatacagcattatagaggaaacacttccaattagccattttttcaaatgacatttactgaaggccattct

SEQ ID NO: 107683 - DNA, 325 bp, Homo sapiens
ggtttctgtggaactgcacttggtctaacacaggggcatattaatgaggactccatgttcaacaaaacataacctcccaataacaacacagctgaggcaagagaaatttcagtatttacatacacatgttcaggaggtcaccacttcctgttcctcaaaactccctcaaagtctgtctctccccaaagaaacaagcatatacgccactctctacaaatttatcggagtaattaaaataaatataaaatacttttaaaagcttttatgtgtccctgaaaaaccacttaattcttaacatagtctcctgccctagagaaacaaatca

SEQ ID NO: 107684 - DNA, 759 bp, Homo sapiens
ccaagggggagcgaggctgggggaccgggtcgcggagacccggcttcgcacaccttttggaagactcagggagaagcgggggccgccttcggggggaaaggcgggactggggagcccacaggccatggctcctcccacaggatccccaggccggaggcgggatccccccatgatcctcccgtggcccccgcacaatctggggagatgcggagctgcccagagagggctctggggcgacagtcactgcgcagggacaggacaggactcccggagtcccagctgccggcccagccccaccctgcggccgagaggaccgagggccgagctgctccaggggaactcgggtcccagaccccggagtcgcagcggacaggcccgggtcccgccacagccagatccggctggttccaccagctcctcctccggtctcgggacgtccggccccgcacactcagcatttccggcttccgggtgtcccggcgtcctcccctgggcctgctcacgtcgcagaggggcggcgacggggattagaggggaggagggcctgcgcgagcagcaaagaccccaaaccccaaaaaacaaagaaaccgccagaaactgaagcttccacagcccgccacgtcccccggctacggctacgctcctgattggatagttagtacggcccctagtgcccctgattggataccgcttcaggtcccgccccctggggttagaaagacaggagacccgagaagacacttggctgcgtggagccca

SEQ ID NO: 107685 - DNA, 1421 bp, Homo sapiens
agtgtcccgaaagacttacaaattcagatctgacttgttcatttgtgtaggggagagttggtggcacacatcctctctgtcactgtaagtatgttccaaatgtcacattaggtccactggcacgtgtaagccctgtctggcatttgcctggtccctgcaggcatttgggttggcagtaaactttcttttctaacagatttctggaaatgtttacatgtagcatataatagaataatagaaccacagaacttccacagtaaagccttccttcttttatgttccaaaagctaaaatgtactaacaacctccaaaaggcactatgacattggagtttaaactttgtggagcaggactcaaagctggacttagctgcttgctaactttgaccttgagtgaagagttagcagatgatttaaagtgtaaagtagaaagaattcatgctggttagcccattaaatacccgttaattaagctctccaaaaacgccattcaaaaatgtatatgataatcaaatatttattgcaatgtttcttaaaatagtgaaaaattagaaaacattatagggggctagtgttaaatcatggtgtaaccagaaatgaaacattatgcaaccataaaaaggagttctgaagagtagttcccggcatgatataatgtgaaaaaaagcaaaatacgaaattgtgcaattctaattttgcaaaaactttcagcgtacacgactatcactgtataaagtcacaaagtaggaatggtgattgtatcttggagtgatgagattataagtgatttttaattttcttcactatgctttactgcaattaaacatttacaattcaattttatttaacaaaaatatataaaacttctcaaatggagtaacttcagtaccagacatcctcaacctgactgctctggaggttattgtgcagagcaatctttgaccatatggtcacagatccagaagccagacgtctgtggggctttgctcctgagactgtgacctttgattcctgcactcctcctcttgccatctgacgccggtctgcgcctgtgactgagtgaaaatcgtcataactgtactcggaggttaactctggcatgactgggatggaatcccaggcaacatgctggaggcaggaaagaaggccagccggcaagtcagaaccaaacaccctggacggcacctttccttacaaatgcggttcacaggacccttggggatcctctgcgcacactgaggcaagcagcaatggaagaaattatcttccactcccttcttgttgaaaatgtctgttttccagaaatgaattacagtaatagattatgaaaattgtttccattgcctacataacacagcagggaattctaaaatttcaaaacatgtaatatactcaacctgtgcttgagactgtagggtatta

SEQ ID NO: 107686 - DNA, 168 bp, Homo sapiens
aatgaaaatggcatttgttccagaggcaagagtagcctccaaattagtagaatgccagatggagatgtggggtggggtgggatggggagaaaggtgttgaagcaactcaatcatgctactactaatagttcctcttgggttgagacttaggatggtattaaattcaat

SEQ ID NO: 107687 - DNA, 314 bp, Homo sapiens
gggtggagtttatggcaaatcccaagaggaaagtcacaacatagatacgagagttctggggtcaggcggggccatctgcagcagataattgtactctgtttgaaaaagcagctcctgggacgctatggggtcccggcagagacagagcttctgacgagggacgcgaggtgatggtgctgcccagaagtgaccatcatgaggcctgagacccagtaggtcctgagatggggtcagagggtgcatgttggccacatgcaggtggctcggactcctgtcccctctacccctgtcgcaccgtgtctgtgtctgctcac

SEQ ID NO: 107688 - DNA, 534 bp, Homo sapiens
ggaagggcaggaggcacacctgccaggaggcacacgacctgccgcccaaggcaccaggaagggggcggggcaggcacaggcgctggagacacacaggccctgccacccggtggctgccgccgtgagtgggagtctggatgggcaccgggcaggcggggggcacgttcccggcctagggtgggaccagtgctaaggagactggagaaaagcacagacagggtttgtgagtgagccctaaggcagggacgggagtagcaggggacagatttttcgttcattcaaaaaggtttctggagggctacctgtgccaggcactgtccgaggcactggggatactgcaacacccagacgcctccccttaaggatctgtcaggtcagggaaaagcagggcggggagacaggaaactaactgcttgcacaggggcgtcagggaaggcctcctgccaaggcaactctgcggcagaggaggtgcagtgctgtgtcaacctcctggggacttgctgaatggcaggatgtggggtgagggcaagggcc

SEQ ID NO: 107689 - DNA, 265 bp, Homo sapiens
aatagaaactgggtttggccaggctggtctcgaactcctgacctcaggtgatccacctgcctcggcctcccaaagtgctgggattacaggtgtgaaccaccatgcccggcccgggaagatgctttttatatcaaaaccacagcattttaatcctattttacagcagaatgtttccaagcttaatttactttgtagtattttgctaatcttctcttgtaaatttccttaactgtctccttatcagactgacttacttttcactgta

SEQ ID NO: 107690 - DNA, 523 bp, Homo sapiens
taactatccaaagaaaggctataaccagaggtgaagaacctggaaagccatgctagagtttggaattgattctgtggcaaaaaggagtgattactcctgagaagtagaaggaacagtgaaatatgacacatctgtagctgctgaatctggtagtaataaggctatgctgcccattttttctagtattttacagcaatctcattttcccaattatttaaatgggttcttatctcttggtatagtatatagatttattaagtaaaagaatataactagatttttaagtcatccaatgtgacacttcctgctaatagcctattttaatcaagttacattttttatatttacagatacatctaattttattcctatcactttacttcacactttccactttttgaggtttttccttttattctcctcttccttcttgtcctcttttgctttgtgttttctgtttctctttcccccatctctgatggaaagttacacatcatctccctccattcatccctccctccct

SEQ ID NO: 107691 - DNA, 712 bp, Homo sapiens
tgttttttagagacagggtcttgctctgtcacccaggctgaagtgaatagtatgatcgaactctggggctcaagcaattatcatgcctcagctctgggattacaggtgtgcaccactgtgcccggcccttatttagcattcatatcgcctgctatgtaccaggcactgtacttaacacttgacagatattttaactcacataattctcatggaaaccctgagagatagcgtattagtcagttttctttttgctgtgatgttgctatgtaacaacccctgtcccccgcccccaaactcagtggcttacaacagcgagcactgattcctcactcacgggtctgtgggttggccgtggccttgccgattggctgcaaggagctgggctttatcagctgcagttgaactccgatttctttcaagtgtcctctcttttaggaaccaaccagagtatgttcactcactcagtgggtggcagaggcacagagcacaggcagagccaatgcatttgcagcttctgcttgtgacacatgcccacattccctcagccaagcaagtcacatggctaagcccgacactgtgagccgggaagttgcatgccacaaggagggggcagacaattcttctaaagagagggaaaggtgagtcagaaacaataacctaatctcccgcaggtcggtgctcttattacccacattttacagatgggggactg

SEQ ID NO: 107692 - DNA, 435 bp, Homo sapiens
gataagaaacagctggaacagttttctatgaattataaatatgtttatgtcccattggtcttcgagcattattgttaggatatggaatggcaagtaagaaaacactgagggaaagagggtcatggtaccgggagtgtggaaaacagtggccacatcccactcacccagttcttatgatattttcagtgattttatgaccaactcctaattggcttagactgatttttggagaaccagataaataagctccaagttatctctacaaacactcttttccaaatagattagaaaacctgttcttcaaaacaagccatggacaaagtgccttagttgaattagataaattgtactagtcaatgaatccatgcactaaaagaacacagcatgtttttaaaggaattaaatcttgcttttcctgatgtcatctgaggacat

SEQ ID NO: 107693 - DNA, 320 bp, Homo sapiens
agtccccacagtaggtcacctgtaagctgggaaagagagaagctggtagtggctcagtctgagtccaaaagcctcaaaaccaaggaagctgacagtgcagcctttagtctgtggctgaaggctgagagcccctggcaaaccactggtgcaagtcccagagtccagaggccaaagaacttggagtctgatgtctaagaacaagaggagaagaaagaaatatccagcacaggaaaaagaaaggagccagaagacccagtaaacaaggttatcttaccttctgcctactttgttctagccacgctgacagctgattggatggt

SEQ ID NO: 107694 - DNA, 361 bp, Homo sapiens
acatataccatatattaactaacctgccgtgcgatctggggcagcacctcataatcaaatccattaggatttcttcagcaaatctgggaatattacattaatgtgggattaatgtttacactaatgtgggataaagactattcataggttcacatcagctcatatcaggctttgcctaaaaattaccaaaaaaaccttgagttttgagagctttttagcattgtggattgtgaaccatgggtgttagttttgtccctcatcaagtaacggcttcttgagaacaggtgttgtgtatgcttcttcctatgatacctagtacagtgttggacacaagagtgctcagtgattaactgcctgataa

SEQ ID NO: 107695 - DNA, 917 bp, Homo sapiens
gagtcggtaaatatttgagtgaccaccgagtatcaatcagccaccttattaagctttgtagggggagactgaggcttgattttgcccttaaggatttaaaaatctgctggtgttacacaatgctttgagacaggttaatgctgcccccggggggtctggggagatggttctggccgtcacagatgtggtaggaatgggtagagatggtggaaaggagtggagagaagtatggatggtagaagcttactttccacacatcctatcttcatttcttgattcaagtgattctcttctgtaccttggacagctcagagcatgggcctcagtttccccatctgccaagaagatttatattggagtgcctctcaaattttttacccctaaccctctctgatgaatttgttattcttctcactatcatttggatgtttgaagccccacagacacttattttctccatttggattttgccacgtgcaaagaccagccagagagatgaaaatgggtaggataaagtcttatgctaggtaatagacttagaataaaaggactagaaattgtggaaagagaaggtggaatcattttgtagcagagtgtgacatgaaggacgctcagaatcaggtttctcatagataacgttttgtctgtgcatagcatttgttaaaaaaaaaaaaaaagtcggccgggcgcggtggctcaggcctgtaatcccagcactttgggaggctgagacgggcggatcacgaggtcaggagatgagaccatcgtggctaacacggtgaaaccccatctctactaaaaatacaaaaaagtatccgggcgtggtgttggccgcctatagtcccaggtactcgggaggctgaggcagaagaattgcttaaacccgggagacggaggttgcagtgagccgagatcgt

SEQ ID NO: 107696 - DNA, 265 bp, Homo sapiens
gccaactccagaggcctgtccaactccagaggcctgcccaactccagaggcctgtatgactccaaagtcagtctttctattaaacccaggctgcctctcactagacctaaataaactcttcttgctttttaaccaatttatggataaggtaaaaattacatacctaattctgaattctgggcttggttccaaagtggaaattcttcagctgggcgcggtggatgctgcctgtaatcccagcactttggggggctgaggcgggagg

SEQ ID NO: 107697 - DNA, 175 bp, Homo sapiens
aggttccagaagggagaattcacctctttattcctggaaggaataagcggtctagtattcttattagactctatttctcttgttctaacatctgacattatcagcctagtttagtcgctctcaatgtttgttgcatatatattgcatggaaagtttatgaaaaagaatctctttg

SEQ ID NO: 107698 - DNA, 382 bp, Homo sapiens
aagtcagtactccatactggaaaaagccccctgcctgcaattcagacaacctgggttcttgcctcagttcttctacctcctggcttggggatcttgggcaaatttctcaacttccacttcctgatctgtaaatggaatgactcaatgatttttttttttttttttttgagatggagtttcgctctttttgcccaggctgcttccgaaaaatcacctgaggctcaggattttgatctccagcctggccacctgtgtgaatctcccgtctctactataattacaaaaaattagctgggcgtggtgacacttgcctgtcacccctgctacgggggaggctgaggcagggaattcgcctgaccctggaaggcggaggctggattga

SEQ ID NO: 107699 - DNA, 368 bp, Homo sapiens
ttaggcagggtcttgctctgtagctcaggctggagtgcactggtgcaatcttggctcactgcagcctctgcctcccgggtcccggttcaagcaattctcttgcctcagcctcttgagtagctgggattacaggaacgcaccactatgcccagctaacttttgtatttttagtagagacagggtttcaccacgttggccagactggtcttgaattatttaccttttacaatagttcaggactgtgacaggagatatgggggaaaatataccttcatcttcctattttgttccagactgattgtctgcctgttctccataaacttcttccctctccccactcccagtcacccagattggggaactgacct

SEQ ID NO: 107700 - DNA, 6628 bp, Homo sapiens
  misc_feature (4233)..(4233): n is a, c, g, or t
ggaagtgggcctggcaccttcccggcctgccgcaggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccanggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaaaaaaaaaaaa

SEQ ID NO: 107701 - DNA, 4194 bp, Homo sapiens
ggaagtgggcctggcaccttcccggcctgccgcaggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaaaaaaaaaaaa

SEQ ID NO: 107702 - DNA, 4831 bp, Homo sapiens
  misc_feature (2436)..(2436): n is a, c, g, or t
ggtgtcccatctcatgctggcttggctggctgggccacagattggcccagataactgcagggcctggagaactggggccaggaccctgggtctctgccaatgcctcaaaggcctggcaccagaggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccanggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaaaaaaaaaaaa

SEQ ID NO: 107703 - DNA, 1385 bp, Homo sapiens
gctcgcgatctagaactaggccagtaacagtgaatctggaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaaaaaaaaaaaa

SEQ ID NO: 107704 - DNA, 6625 bp, Homo sapiens
  misc_feature (4233)..(4233): n is a, c, g, or t
  misc_feature (6069)..(6069): n is a, c, g, or t
  misc_feature (6071)..(6072): n is a, c, g, or t
  misc_feature (6075)..(6075): n is a, c, g, or t
  misc_feature (6077)..(6077): n is a, c, g, or t
  misc_feature (6079)..(6079): n is a, c, g, or t
  misc_feature (6094)..(6094): n is a, c, g, or t
ggaagtgggcctggcaccttcccggcctgccgcaggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccanggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggccgctctcgccccccgccccccccccccccccccccccccccccccccccccccccccccccccccccccccacgcccancnnccnananagaccaaaagagaanaaaccacacaacaggaaaaaaaaaaaaaaaaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaaaaaaaaaaaa

SEQ ID NO: 107705 - DNA, 871 bp, Homo sapiens
ggaagtgggcctggcaccttcccggcctgccgcaggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacaggtttggccaccctaccctgcacccagggtccctcaggacctccagtggggctgggacatggtatcagaacccccaggttctgagctctgtctgcccctcttagtggggtcggggaccttaaccagtgaaagcagtgatttgctagtgccatattcatgcctcaccaaggaagttgaatgtaggggttaagagcatggatgctagagtcagatggtctcaatatatcctggctctgccaattccctcctctgtgaccctggaaaggaatgtaacttcagtttcctcatagataaaatgagtttgatggtaatacctacctcaaagggttgttgtgagtattaaatgggataattcaaataaagcactttagtaggatgtgggttccctagtaaatgctcagtaagtgtttgctgccttccatcacaattaccaccttcagcacca

SEQ ID NO: 107706 - DNA, 177 bp, Homo sapiens
gagcaccccattccagaaagtgtgagagctgacagttaacaagtctcatcctgctggccttgcagatccagaactcaacagagaccccatctgcgtatgacctgcttattctgaccacaatcccaggcctcagttaccggcactacaacatcagacccactgcaggggcccaagagg

SEQ ID NO: 107707 - DNA, 6806 bp, Homo sapiens
  misc_feature (4411)..(4411): n is a, c, g, or t
ggaagtgggcctggcaccttcccggcctgccgcaggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacagcttccgggccgtggttgacacgtggtctgatgaagaaatgaattgctctggtgtctgcatgctggctgcgtttgcgtgtgctgtgtcacgttggttgggagctaagttcagagctgggagagagacccacagaccctggggcccacagagcacctgttcttccatgatcagagcagacgaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccanggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaaaaaaaaaaaa

SEQ ID NO: 107708 - DNA, 1617 bp, Homo sapiens
aggggagcctggtgaggcaagggcagactcaccagatggtctcagaaagctcttgggctttgagggcaacacccatgaggaattgaggccactagggccaggaccaacctatgaattgccctcagggtgggcagaaacgccaagaggcccacaggagtcctggcagaaggggatgccataggccgttgccacggtgggagccacagcagactgtagccaggtgcagtgtggtgagaaggaggctgggagccacagcagattgtagacaggtgcaggagggtgagagggaggctgggagccacagcagactgtagacaggtgcagggggtgagagggaggctgggaggaggcatcccaggccacactggacagatcacctctgttcccctaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatgaaaaaaaaaaaa

SEQ ID NO: 107709 - DNA, 6015 bp, Homo sapiens
  misc_feature (4233)..(4233): n is a, c, g, or t
ggaagtgggcctggcaccttcccggcctgccgcaggatggggcagctgtgctggctgccgctgctggcaccgctcctgttgctgcgaccgccaggggtccagtccgccggccccatccgggccttcgtggtgccccacagccacatggacgtgggctgggtctacactgtgcaggaaagcatgcgggcgtacgccgccaatgtctacacctcagtggtggaagagctggcccgcggccagcagcgccggttcatcgctgtggagcaggagtttttccggctgtggtgggatggcgtcgcctcggaccagcagaaataccaggtccgccagctcctggaggaaggacgcctggaatttgtcatcggaggccaggtcatgcatgacgaggctgtgacgcaccttgatgaccagatcctgcagctcacagaaggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcatgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacaacatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacggggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccanggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtttggggacccccgcttcagctccctacccaggactcccagccaggctcagcagctggtcagacccggtgcacatccaaccatctgcctgtcccggcctgtgcgaccttgcgaggctgctttcctactctgaacccgcagccctcccaaatctactacagtcggttaagaaaggctttgggttagtctctgcctgccagggctccacacaggcgtgtgtgtgcacttgtacgtgtgcacacgcagaccacacgccctgcctgtgccctgggtgacagctaggggcccaggggcttctgcccaccttggccctgctgacctcagcccatcagccggtccctgcctcatacgacatgtgccaccgtgagctcctgcactacaggcagcttccaggctccagtccctgtccgcaccatgccctctgcctgggacgcacaggtcccattcactctggccagcacctgctcaagctccccaggatgcctccccagagtcaccaaccaggccaagtgcctcctccactctcctggccccagcggtttcttctgtcctgtgcagctcgttgtccactacacacagcatggtggcgggtgcatggtgacaccacctctcc

SEQ ID NO: 107710 - DNA, 395 bp, Homo sapiens
cacatgggtgtcctgctggacagctcagagtcagcatgacaaaagcccgttcctgcactggtttcgcttgcagaccacagcctgggtgagccagttccatctcttgggggtgccctctgctgacggctcacggttcctgtctgcaggctctgtccgtctcctcgtttgtgacccattctgggacagcatggagtctaaggccacactggctgtgggtggggtctcagggcttctagatgagctgagtcacatggcctcgtgagtgctacgcaggccactcagatggcatctggagagagaggcttgccagccggtgtctgtaagaccttgtgcaggatgagaatgacatcttctctctcctgcctctgcagacagagtaaccgaacggtgcgcgt

SEQ ID NO: 107711 - DNA, 128 bp, Homo sapiens
catcaggcccagagatttaaaacttcttctcattccccctctccctatgatactaggtgagaaaagataagataagaacttttatctgaggactatgagtccttttaaacaatcaggcccagagagac

SEQ ID NO: 107712 - DNA, 512 bp, Homo sapiens
tcctgacctcaagtgatccacccacctcagcctcccaaagtgctgggatttcaggcatgagccaccacacccagcctctctttattttaaaacgaaggttattgcttcctgatcagtatatattttatggtcacattatataataaggtcactcagtttgtgacccactgactggattttgtttccataattacttttatgcttacatttctttccttctttctttttttttggagacagagttttgctcttgttgcccaggctagagtgcaatggtgtgatctcagctcactgcaacctccgccacccaggttcaagcaattatcctgcctcagcctcctgagtaactgggattacaggcgcccaacaccacgcccagctaatttttgtatttttagtggagacagggtttcaccatgttggccaggctggtcttaaattcctgatctcaggaggtccacctgcctcagcctcccaaagtgctgagattacaagcatgagccaccacgcct

SEQ ID NO: 107713 - DNA, 258 bp, Homo sapiens
aactactcagaggctgagggagaggaattgcttgagcctaggaatttgaggctgcattgagctgtgatcatgtccctgcactccagccagggtaacagagtgagaccctgtctcatagaaaacaaaatacatgggttcttcggaggtcacagacctactgtgtgtaaccgcactagtctctgattcctgcctaacaaacttgcgattccttgacatataatccaagtaattaaggtatcttagaagccatccatctgg

SEQ ID NO: 107714 - DNA, 852 bp, Homo sapiens
ggctgggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacagaat

SEQ ID NO: 107715 - DNA, 543 bp, Homo sapiens
ggctgggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagaggtaaatgcttggctttctgcagtgctgtgctttcaagaatttaatatcctgctcttaattttggatgacatatggatgactgagccatagataaaatatttctggctgggtctagaaggcctaaa

SEQ ID NO: 107716 - DNA, 142 bp, Homo sapiens
gtatgttagtagctcgatttaatcattccacattgtataaatatatcataaatctttgtacttcataaatacatacaattataatttgtaaatttacagtgaaaaatatattaactatgagtttttgtgtatgccctttgta

SEQ ID NO: 107717 - DNA, 361 bp, Homo sapiens
agccaccgtgctgggcctgtagtgttttctaaaaatagaattatattataaattgggtttatcaacttgctgaaaatggcagaggccagtgcgatgagagtagggtgattaagggagtaggaagtaatgcaggaaagggagtttgtaggatttagatttcactgaaagtgtactggacaggttgggcatagtggctcaggcctgtaattgtgtcactttgggaggctgaagtggaaagatcccttaagcccaggagttcgagccagcctgggcaacatagggaaaccctatctctataaaataaaaataaaaataattattttgaaaaaaaagtttactggacagagtaagttcagggttg

SEQ ID NO: 107718 - DNA, 719 bp, Homo sapiens
aatctctcattactgctgccagttctcttgtgtgcaaataccctccttaccatagtaagctctaacaccctgtgccaggatgtcaccctaggtgaactcctccttatcttgtcatacattgattctccattcttggccacccacatccccacctgggtgggcttgtcattttttttagggtctgacactccacaccaggccacccctgtgtgaatgttctatcttgctctgcctaatggtttcaggaagggaacaggaagcttaattactttttaaagatgaattttattaccctttccgttcttcatgagttttacttatgagagtttgcaaagatatgttagacctaaatcagtatctctggcttcaagaatggaaggaaggtacacaaaactggtaaacaaattgatttttgttttaggcacctgtaaagaaaaactgattattttcaagaaggaagtgaatctaagaatccataagaattttagcaatgagtaagaccctatccaggcagctccatattcattcctgacgataaatcaaatgggttatttgaaagaaagacatagtaattttccttgacatcagccagtcattactgccatttagtcagcacatccctgtgtgctaggcattgtgtttaatccttaagtttgtatggtggtttctatttttacctgtgtgttaccgatgaagatacctgctttactttaccaaaa

SEQ ID NO: 107719 - DNA, 358 bp, Homo sapiens
gaggcagagtctcgctctgtcatgcaggctggagtgcagtgttgcaatctcggctcactgcaacctccgcctcctggaatggatataaatttctatccagggtgggtaagacataaaacctagaatttgatatgtgcaaaacaatactgcacaaacaacacttgtgccttaaatgtctctttgaacaaccactagttagggaaaagatggatccgatttttactgttatatttttaatttttatgggtacatagtaggtgtatatatttattgagtatatgaaatattttgatacaggcatatgatgtgtaataatcacatcagggtaaatggagtatccttcacctcaagcatttac

SEQ ID NO: 107720 - DNA, 269 bp, Homo sapiens
agtacttaccactgtgttccagttttctaaagtactcagtacagtcacatgctgtaccagtttgtagcctaggaacaacaggctgtaccatacagcagaggtggagtaggctatgtactctaggtttgtatgagcaccttctatcatgttcacacaatgataaaattgcctaaaaattcatttcctagaacatatccccattgttaagcaaggcatgactgtatttggtgactgggaaaataaattcctatttggaatttatttatgcc

SEQ ID NO: 107721 - DNA, 627 bp, Homo sapiens
atcattatctgcagagaatttcagtatatcttcgagttccttgttagtatttatgctctcttatttgtgttgggatagaaagattaaggaaaggagagatgagaaggtggctcaacagttgagacagttttattgggagtaaacctgagaagggcttccagcggcagggtcaggtgcaaacttctcttacagcctgaggcttttttaaagggcccagtggagaagtgtgctttgaaacaaaattctgttagggaggggttggggaagtcctggctgttctgttacagttagggccgttattctctgttgaagttatgggcggggctgacattttcagttttggccaggtggccaaatagaaacttaaagcttaggatggtggagtgttataaagatggcggtgctcttgtcctgtcaatgtgttcctcaataaagtcttcaagcatgtcatagattgttttccccaccaacctcccttgcagcatttgagatattcctgatacttcatcaatagtggagaagctcctgaaatcattgacttcctcactccataatggtttccaacacccaatgaagtagtaggaggaaaacatgggtttcttctcctggaagcctccagaagaaggt

SEQ ID NO: 107722 - DNA, 315 bp, Homo sapiens
ctcctttgtaaagtggagataacaacagtgcccagcccatagggtggattttgtgaggctgaaattagttaattatatgtaaagcacttggaacggtgcctcttggcatgtaatactcactggacaagggttagtttgtatttgtattgttgtttcccaccaagccctgcgcaaagttagttgcacgcaggtttagttacattctcatcaggtgctcttaaccagcttattttacaaaagaggacactgagttcagagaggcttatagcagtagaaccaggactcaaaccacaggctgcctacctccaaagctca

SEQ ID NO: 107723 - DNA, 383 bp, Homo sapiens
agggtgtggacatttaacagtttcatcttcaaaataccccgatgagctatgatactcttaggtgttctcattttacaatttggggaaactgaggcccagagaaggcatgggatatgtgtagccagcagctgtgcaggaatttgactcctgcttatacctaccttgctgcattttggggttttggacatgggtgaagttggacggaacccaggctctgtcattggtcattgggtgggatggtgaagctccctgagcctcagtggcaccatctgcagaatgggacagtagtagtagttacatcatggggttgtgaaaaataatgccactacccagctcagtgtggcctggctcagcatatccacttctctggggaggagggatta

SEQ ID NO: 107724 - DNA, 669 bp, Homo sapiens
tgcagtggctcacgcttgtaactccagcactttgggacaccaaggtgggagggctgcttgggctcaggacttcaagaccaccctaggcaacatagtaaggcctcgtctctatgaaaatttaaaaaaaaaaattagccaggtatggtggcacacacctgtagtcccagcctcctggggagctgaggaggaaggatcacttgagcccaggaggttgaggctgcagtgagctatgactgcaccactgcactccagcctgggtgacagagtgagaccttgtctcaaaaaaataagacagaaaacaaaaaactgcccaacttcttcaatagggagttaaatccagaacttgtctgtatccgaagcttttccgtaataacacaatgacttcctgagcatcaatgggcacgaagatttgtattgcagtgtcctagtgtaggggtcagtcaactatagcccccgagccaaatccagctgctgactttttctaaataaagttttattggaacacagccacgtcctttcacttacccatggtctgtggctgccttcaaactacgacagcagaaatgaatacttgaggctgagaccagatggcccacaaagtagaaaatatttactatctggcccttcacaggaaacgcctaccaatcctatcctagaacaccataaatg

SEQ ID NO: 107725 - DNA, 262 bp, Homo sapiens
actcacaacacctgtataatgtgatgcaagtcatcctctctatcataacccctccccccaacacacagtaggtcactccccaacccctgaagaaagtggcttatttgaggttgttggtgctgttggtattattgccatagttgttatttaattgcttgattaaactcagtcaaatatccttcctaaaaacatgtcattccacttgtgaaagaaaacacaatgtgcatgtttcaatgatactgtgcggaaacacacctcatga

SEQ ID NO: 107726 - DNA, 322 bp, Homo sapiens
aggcatttctcaaggcaaactcctactcacacatcaacacctagctcagaagtctgggaagccaaagaaagacagccccaagtcactcagctcttctcttcctctcagcacttcacaaactcctgggtaacactggtatcttctctgtattattccccaattccatcccattatttggatgaagagttcaataaacattttctgagtaaataactctacatgaaaggttttaaaggctaaaaagtgatacaagcaaaagcagacaacagatatttcttgttactgaaataatctattttctcaactctgatctttggtggag

SEQ ID NO: 107727 - DNA, 1256 bp, Homo sapiens
acagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccccaatttaaaatgtggaattcagttggtgtccaagacttatcttgagactcttaaaagcatcagtctgtaactagaacaaatacagtcttagatttacccaagtgcctagatatcattttataatgattagaattgagtattgtgggtcccctaattctgtgggtgccttaagtgagaatttctaaatgattttcacattctaaatgactttgggttttgaactctccatctagtttacttctaaaatgggaacttgaggcaattcaggtatccaggcaaatctttgtatatatttttttgtgtacatgcacacatctcgaaatccatttccgtgtttaatgttagttgtttatgtgttagtattcctgtgtctactgttttgttgttgttaatatgggtaaagtgagccctgaaatacatgctaaacaagacatgaaatgcagaaaggtacatagtgtttcaagtgcatggtagtttgatctgtgttttactttattgtgttttcttgagtgtaaagaaagaataaatcaaagttcttcatacctaaaaaaaaaaaaaaaaaaaatttggcggctcgcggagacttttaacccttttggggcgccggaaggaatgtcaggtcaggaacggggaatggggttaccaaaagcgggggcggttgaacagtttggttgttagcgtgcctcccgcgccgagagaaaggacaataggg

SEQ ID NO: 107728 - DNA, 1008 bp, Homo sapiens
acagccatggcaagcactttaaccaacttctatggtgatttacgaaaagctttatgagaggcaaaatacattcaaacttgtagtactacagatcaactctctcagctacatggcctgtaaaaatcattgattccacttttctgcatagccggtagaaaaatttgaaatgtttttggttcactagtacaatgtttggttttattcctaaagtaaatagctatctaagagagggcattttcacttttttttttttaaattttgagacaggctctcactctgttgcccatgctggagggcagtggtatgatcacagctcactgcagctttgatctgaccgctcaaggggttattctacctcagcctcctgaatagctgggaatacaggtgcacgccactatgcatggctaatttttgtttaattttttgtagagatgtggtcacactgtgttgcccaggctggtcttgaactcctggcctcaagtcattccccaccttagcctcccaaagtgttgggattataagcgtgagccaccatgcctggccattgtgtctgtttttatatagcataacagtggaattcagtaacttaaaagttgttggaaagtaggcaaagcaggaaggaactcttggtttttaatgaggtgatagaaaaataaaaagccagaggctattctgactgatggagggaggaggatatcttcagtgtgtcaagcactggatagattacttaacggtgtgtgttcttcacaggtgctttctaaggtaaagagatacttattttaccttgagcaaatagtttcctgtcccaggttaagaagtcaggcagtagttataccttttaaaactactaaatgtttcttaaattgtggcctgttgatggaaatttcttgacagatgacactgttttctctggacttgatttcgaagacaaattgcttcttagaattgtctttgcgtgggatggccggtccggggttttggccgttaacttgttattactccggcaaa

SEQ ID NO: 107729 - DNA, 227 bp, Homo sapiens
tgagatcatgcaactgcactccagcctgggcgacagaatgaggctccatctcaaaaaaaaaaaaatcatctaagtaaaggaaagtaatcaaaggataggaaacaaggaatcactcttcattatatgctgcttacgttaaattactttataacattgtgcatgcagtagttgtctatgtggaagttcacaaaaccatcactgggcctatctactagcaccctcctcct

SEQ ID NO: 107730 - DNA, 141 bp, Homo sapiens
cctgcttagagatactctgattcctctcactgctatggaacagacacacacacccacacaccaccccagctgatgttgtcacactcacacacacacacaccaccccagctgatcttgtcacacacacaccaccccagctga

SEQ ID NO: 107731 - DNA, 235 bp, Homo sapiens
ttttattttttgctattgagtttgagttctttatatatttgggtattaatcacttatctgatttgcgcatttaatcattttccccaattctgtaggttgtctctttactctgttgtttctttttcttccaaaagctttttagtttcatttaattccatttgtgtatttctgcttttgttgtctgtgcttttggggtcatatccaaaaaatcattgccaagaatattgtcttgaag

SEQ ID NO: 107732 - DNA, 104 bp, Homo sapiens
ggtccaaaactttagaattaatatttgtaaaagagaatcattattattttccacaatattagaaaaccttgtatgacattaatcatttattttctgattcattt

SEQ ID NO: 107733 - DNA, 181 bp, Homo sapiens
catttttggttgctgtgcctggaggaagggtgccgccgtcatgtagtgggtagaggccagggacgctgctcaacatcctttagtgcccgggacagctcctcaacaaaggattctctagctcaaatgtcaatagtgccaaggtggagaagccacctgggtataaacccagcccagaaatgta

SEQ ID NO: 107734 - DNA, 575 bp, Homo sapiens
ccgtctagaggatccggtcgacggggatttagacacaagtactctctacaaatggcagacaaccaagttgatgattcactgttagggcaatggcttccatgaaacactgaatcacaaaagcggaaatactctgaactcccaaccaagggagagaacacaggcatttggagaccaccacattctttatatactttttgaaatctaaagcatacacctattacttatacttctgaaggtatgtccagacacccagttaagcaactctaagtagaaaaatgaaatttaaaggtttttaaaatttaaatattcttaatttaaacagccccaattcataccgaatggtcataaacataaaacatcaagtcttactattaagatttttacttcaagaactaattctacaagtatgactaccctacaaataatgtaaaaaccgacttcattttggcagcactggtaaatcacgcatactaaaatcattctaccagatgacaattcaaatattgaaacacagaagaaaaataaaatatttgacaaggctttcatttagaaacatctcaggacacagttcagtc

SEQ ID NO: 107735 - DNA, 369 bp, Homo sapiens
aaaagtcagagtaatgccatcataattttttgttgttgttgaggtgtacagtacttccaccaggctggacaagtaaagtatgcaacactaacataattcacctggaggtggaaaatatttcagaaagcttagttataaaatacggatgttagtggtgtctgcacattggaagttaacaatgggatcactgtggtaaaaaatgatttacagtatattattccttaatttcatatgtgctttgagttccaaatataaaagctgtttgttttatttctctgcagacccagtttaagatgccagcaaacctagaaattacttttgtttttcatcccaagctgtataactttagaagaatcatagcctgtgcag

SEQ ID NO: 107736 - DNA, 378 bp, Homo sapiens
tctaagaccttgcaatacacgaactgttcagctgagcagctcatctcccccttccacatattgctgctctcaagggagataaattaaatatggaacagtagacaaataaaaactactggggcttgtagggccccaaaagcataaaaggacatggtaagtaatgcttagtggtaacaacaggaatccctctacccttattttcaaccctttctctgccattttttcaaaggagcatgccactttctcattaattagtctctgtgcatgtagttcaatcaaaaattcacaagaaaggggcagatgatggccagacccttggttttagtttctgatatccccttcactgtttctgagattggatggagaacatcaacttgt

SEQ ID NO: 107737 - DNA, 399 bp, Homo sapiens
agcctaccgcacgcctttgttcttgtgccaacagtgcccactgcccggtagtgcctgtgtgtgcggtggccatgatggcaccacaatgtctgaagccacacagtgcatgggtgacatctgtggaaaggacctggcaccggccagcacacagaggcactcacctgtctcacacaatgcactgtggtcccaattctagttttgtaaaactaccttgagatgactccttttaaaattatccttaagatgtctttctttttctaaagcttattaaaggtcattttcaaaacgttttcagcaggaacttggtgtatatttgcagttctgcatggaaaactaatggagtcatgatggctgctgatgctgatgaagtagtaccagccagcctgatttcataacttc

SEQ ID NO: 107738 - DNA, 302 bp, Homo sapiens
aaaaggggagaaaaatctccacaactcagaactaagccaacagttcctagacttgacaccaaaagctctaatccacaaaaggaaacactgataaatggaagctcatcaaaagtacagagtaagaccctgtaaacaggatgaggaaacaaattactgactggaagaaaatattttcaagtcacacatctaccaaagaacttgagattagactatctaaagaattccaattagaaaactggcaaaaaatatgaatagacattttactaaagaggatgtaggccaggggcggtggctctccagca

SEQ ID NO: 107739 - DNA, 532 bp, Homo sapiens
gtcagactcccagccttgtgcaatataaacactccatgaatgtttactgagtgaaagaataagtgagcatcactctatgacaagacatatggcaaatcaagaaaatctgtgtcaggattttttcctcttctacataatggctaatgacactgttttcattcccaactaagaatagtattgttgaccaggcgcagtggctcacacctgtaatcccagcactttgggaggccaaggcgggcggatcacgatgtcaggagatggagaccagcctggctaacatgctgaaaccccgtttctaccaaaaatacaaaaattagctgagtgtggtggctcttgcctgtagtcccagctactcaggagcctgaggcaggagaatggcttgaatccgggaggtggaggttgcagtgagccaagatcgtgccattgcactccagcctgggtgacagagtgagactccatctcaaaaaaaaaaagaatagtattgttgcaagaactttactaaaagaaagtaggaccaacatatgctggaatt

SEQ ID NO: 107740 - DNA, 647 bp, Homo sapiens
gacacactggaaaaaaactggtgatataggagagagagagtgaagagttctggagttatgtccttcaaagattggatctgctgcacaagaggagacatcttttaaataggagcatgggtagttcacctacagtagaaagtgggaacacagagcatcctctacagatgttggtaattggagaggtctggtggtggaaatctggtggtagatgggaagaagataatgtgctgaagttctcttatcactgcttcagttttcccagtgaaataaaaaaaatcatcagttgagagtgaggatatgggtggatgtgctgaaatatttgaaaggaatgtgatagttctatgttctgtaggagaacaaatggcctagggaactatagtatatttgctgggcaccattaaagacccatttaagtttaaagtgagatcgttcagccatattaaatcgcccaggtttaggtttggagtaggcagaaaaattggatttttctaggcttgtgatttggtcaaacacccaaaacaaagtgacagtgaggcaggggaattgaaggcatgtgcaagagagtgaatataatgattaaccataaaatttaagataatctaggagggagataagctgtctgaggagtgagggaaacagaaaagatg

SEQ ID NO: 107741 - DNA, 355 bp, Homo sapiens
gctctagaggatccgttacctgttatccccacccaaagacaagtgtatttgtatgttcatcatagctctattcatcacagcaaagattcatcaatgcccatcattgcccatcaacggtggactcaataaagatgtgatacagagacaccgtggaatactgtacagccataaaaagaacaaatcatgtcctttgcagcaacatggatggagctggaagccatcatcctaagtgaattaatgaagtaagagaaaaccaaataccacatgttctcacttataagtgggagttaaacactgggtactcataaagatggttacaacagacacagggaactactggggtgggggaaggaag

SEQ ID NO: 107742 - DNA, 347 bp, Homo sapiens
aggacatcattcaaacaaaccagaatatattcagatgctaatgcctccactgacccagaaatggaacatgttaaatggtgaagataaggatctcttccctttacctgagtgcctatcttcagttgccacagcactgcagtctggctttcttccatactgtgaacctgtgtaagagacaatgaggaaaacttgcccaagccatgctaaacaatgctcaaccagatcaatatgaagctccagataaagattttatgttagtgtctcttgatttactgagtggcctggctgaaggacttggaggcaacattgaacagctggtagcccaaagtaacatcctaacactaatg

SEQ ID NO: 107743 - DNA, 783 bp, Homo sapiens
gcacttgaagccccgttaataggcaaagctctccctaagtaatatcaactagctaatgtaatcagtctcggtgcttgctttactactgatatatctgagctggtatgctatagagatcaataactcttttgatatgcttgtcaatttgtagtgttgatgagcaatttctcttaaggagtctgccttccaatgttagtgtgccttcataggaaataaaagtgccataatttcatgtgaaacatccatctgttgttaatatttaattattatttccattattagctgagatgtctcaatccctgaaaactttaatcaactgctcctaaatttactgtgtaaaataaattttctttaaaatttctttgaggtgtttatataagttaatagctaattgcattttaaatcttgaatggaaaactagaatatttatgatgtttaagtcattagaattgggcagagcatctttttaaatggaaaagaatattggaaagaaataaatatcttttgctgaaatttatggaagtacacactaatcagctgtgatatttaaatttttttctccctaagtttgttaccttttaccttccatattttttatgtctctcaattcttctaaccaatattttctttagccctcttctttatctcctctttctttcttttttctcttttgtttctttttaaaatttctccttcctttgttcttcatcctttctttctgttataaacattcacatatttacaaagctcatcaataagtgcaagcagtaatgggattgggca

SEQ ID NO: 107744 - DNA, 436 bp, Homo sapiens
tacaaagttgcagtgtgtgtgaatgtctgtgtcattgtttgccaattcccctgcctctgctactaaactgagcacctctatttccctcatgtctttctcagtggttacaaatggcaggtctaaggacaggtatctaattaaagctaggccaattacagtatctctggccttggcatgttgaattgatacaaaggtaggttcccaacgccaatcacgttccttctctgggattgtatatactggaataagatgagattgagatctaatggatagacataaaactcagaaactatttgggagctgtgtattaggcagcatctatagtggaaagagcaatgatattgatgctatgatgaaaaataggttgcttgtggaatttttaatgcgcacgaagctaggaccctaaggaggaaggccaaagtatgacagctccaat

SEQ ID NO: 107745 - DNA, 392 bp, Homo sapiens
atgcatttgccaaatattcagatttctaggagagttattttttgaattatgagagtatatcctttaaatcaaaacatcagtctcctcattgactcttgggtattgggaaaatgataacctgcttaaaaagctacctacatttaggttgaaattatttatctagccgtaatctagttttctgctatattaaagaaaaccctaatattaacattttagctgtatatattttaaaatcgagaatagcaaatgaaaaaatttaacaaaagagaaacatttgagtttcttaatattttggggagaaaattcagaaacaaaactaatgcaatatttgcctctggcagtcattttattatgtttaaaaaaccaagtttttccagcagtgaaggtgtaaa

SEQ ID NO: 107746 - DNA, 485 bp, Homo sapiens
cctgctcctgtaagccccgatgatgatggaaacgacaatggctgtcatgtccctacagcgtgtctgcatccagcactgtgctcaggactttgctcgcattactattaccccttacataagcccgagagagttatttctccttctagagttatttttctattcggaaaatcattatcttctctcttagaaattacaaaactgaaggtcagggagattcagtgatttgctcagtaatgcacagctgatgggaggcaaagctaggatttgaacaaaggccaaacctgactccaaagccaaagttctttctactccatcatgtggacttgagatccggcatcagtaagctacggcccatggccaaacccagccactgtctgttctcgcaagccccatgagaatgaagactggattttacatttgccctccaattcagtgaaatgttttctcccaagaaagaaccccttctgcttttctcattagtagac

SEQ ID NO: 107747 - DNA, 416 bp, Homo sapiens
gtggccggaagactgaagcatcagcacagtaaggaagccattaaattggccaaagaacaatccttagaaacattgtggaaaactttaggggtcaagtgcaagccagacaaagtcaaaaagagagacactggggtcatgagatctatgatgtgcccagtggttgtgatgtgtaaaaaatagagatggtacatggccaggcacggtagttcacgcctgtaatcccagcactttgggaggctgaggcgggtggatcacctgaggccaggagttcaagaccagcctgaccaacatggtaaaaccttgtctctactaaaagtacaaaaaattagccaggtgtgctggcgggcgcctgtaattccagctactcgggaggctgaggcaggagaatcgcttgaacccaggagatggaggttgca

SEQ ID NO: 107748 - DNA, 255 bp, Homo sapiens
gtggattttccaggtgttttggctggttcttgtctgatttaaatagggcaggatacctttttttacgcagaggagcaatcaccatataaaaataattgggcctctgaataggagtcctggactgctctctactttgccccgatttgtacgatgaccttatcacattgggaccaaagcttatactggaaagggtactttggtcccactatttaaggatttcactcatttaataaatattcactaagcctttgctct

SEQ ID NO: 107749 - DNA, 410 bp, Homo sapiens
ccgggttcacgccattctcctgcctcaacctcccaagtagctgggactacaggcgcccgccaccgcgcccggctaattttttgtattttttagtagagacggggtttcactgtgttagccaggatggtctcgatctcctgacctcgtgatcttcccacctcggcctcccaaagtgctgggattacaggcgtgagccactgcgtccggcctccactgcactgtcttgtcttttacctttttttgttttctttagacgggtttccctgtgttacccaggttgaccttgaactcctgatctcctcaaacaatcttcccgtctcagcttctaagtagttgggactacaaggagcccaccaccatgctgggctacctccactgtctcactggatcgtctcactccttgtcgtatt

SEQ ID NO: 107750 - DNA, 394 bp, Homo sapiens
gagtgcagtggctattcacaggagcaatcccactgctgaccagcacgggagttttgacctgctgcttctgacccgggccagttcacccctctttaggcagcctggtgatcccccctaaccccacctcccctcttgggaagtcaccgtattgatgctgagctcagtgtgggcacccgatgggcacagaccccagaaagcccagaactcttgggctcaggagatcctcctaagtggctggaactccaggcatgtatcaccacgctcagtccctttcatctttatagtctccagactctgttagggggagactctggttccactggcagttggaaagattctaaaccagccccaccaccctcttgggagagacttggccccatctgtaacttgagac

SEQ ID NO: 107751 - DNA, 243 bp, Homo sapiens
cttgtttctttcctgttactaacatccccaagggctgccactgtcctgacttttaaaatcatgagtcagtttagcctattttggcaccttacataaatggaatcatacagtatgtgctcttctgtatctagcttctttcgttcagtgttatttttgtgatcatctagttgtagttccagattgttcattcttattgctgtatggtattcaattgcataaatataccaaaagtagtcactttta

SEQ ID NO: 107752 - DNA, 144 bp, Homo sapiens
cgggtctttctggatgctgcggtgggagggggctggacctgctctggggccacttgtgccattccgcccagtcacctcctgcccctttcaggcaatgactgttctacggaggcctagttctctgggtaattctgttttggctac

SEQ ID NO: 107753 - DNA, 645 bp, Homo sapiens
gttccacaacgtgagtgccaagaaggtattttctctcttgctgagagctttctgggaaaagggtgcagatcaggtgaagatgacttgagcaaggtgccttatcgtggagtgctggacagacgagcctcacatggtgtcagccagaacagactgttctctgcagtgaatctgagccttcaagattcatgtaggacatgatttggctaagaagggagtatcacagtgaaattttgttcagactttacactccatttaaaccaagaaaccatagtcttctcaagatagaaccagtttttgcaagctcctcctgcaaacctcccaaaccgaagaaaaaaaaaaaaagcatggttctatcagtaaacctcacaaaccacaggctattcaaagtacagagagctgagaaagaaaggatgttgcaaattctaaagacatttctgtctcgcccttttagtcctgaatctattggcttcagtctctcaaaagtgtgagatggaaataattagatcattttcaggagttctttgggtttttcaataagattttgaagctaagaatcttccttggtgactggtaacttttaaaaacataaggtggttttaccgtgtctctcaaatcaaaaaagttcaggttcaggtcaagaaaaga

SEQ ID NO: 107754 - DNA, 330 bp, Homo sapiens
aattcatgtggggaaacatgggaagagttcagctgtgtgttccttgcagcacaatctttcattgcagaagaatgggaagaatggaaatgcccagtactagaagaacggataaggctgtggtggcctacgcacttactggccttcaccggaatattctgcagcagtgcagaaaaatgagtgattgaatttgaagtgcaagcagcagaatactgtgatttcagttctgccagtctcaaaattaaatctcatttgtaaggcaggcagtattgtgggagaattcctctaatgtatttcattcccagagtgtttatgcagtggcaggaagagtac

SEQ ID NO: 107755 - DNA, 1431 bp, Homo sapiens
tactcaccaacctttattaagtacattttagatactgggattagaagatgatgtcattagacatttctttggttttagcttctgtgggtttgatcaaggagtttattcagtattttaaatcttcccccaaatctggctttaactctttgccttaagagtgctttgtgtttgtttcttttacttagccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacactttttattttgtttttctattttaaaaataaaatattattttctgaatttcttctattgggtaatccagttagaccatattcctctacaaataaaaactatgttgatttcatagt

SEQ ID NO: 107756 - DNA, 3703 bp, Homo sapiens
agcgggcggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggtgaagaaatatcaggctctgatatcagtgggtcagaggaagatgatgatgaagagggtgaggttggagaagatggagagaaaaggaaaaaaagaagggattcaaataggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctagtgagtattaccttcattctttcacgtaataattaaagagtacttcctatggtctagaaattgtgctggctacagtggggaggaacatggtccagtagatgaatcagatgagaatccagtagggcagataaaatatttttctaattccatgtaattaattgtaacatacagatcatggtctgggtggaaatggtcagagttaggggctatgtgggactaagtgacctctggggccctttctgctctagcattcaaatcatgttttactagtgtaatgttaggatttctcagttatttgcctaactcacagtattgattactaattaagacatttctctgtctctcccttttctttttttgagaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacactttttattttgtttttctattttaaaaataaaatattattttctgaatttcttctattgggtaatccagttagaccatattcctctacaaataaaaactatgttgatttcatagt

SEQ ID NO: 107757 - DNA, 2659 bp, Homo sapiens
cgagcggccgcccgggcaggtacgcgggatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggtgaagaaatatcaggctctgatatcagtgggtcagaggaagatgatgatgaagagggtgaggttggagaagatggagagaaaaggaaaaaaagaagggattcaaataggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacactttttattttgtttttctattttaaaaataaaatattattttctgaatttcttctattgggtaatccagttagaccatattcctctacaaataaaaactatgttgatttcatagt

SEQ ID NO: 107758 - DNA, 1965 bp, Homo sapiens
cagcatcacctctatttctctgttaggacatttgctccatctgtatctagtcacagcaaatccaatctcctggaatcagtttaatgagcagaggagattatactggagtcagctgaaggacatactgatggagcaaatgtcctaacagagaaatagaggtgatgctactgcgcatcttacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacactttttattttgtttttctattttaaaaataaaatattattttctgaatttcttctattgggtaatccagttagaccatattcctctacaaataaaaactatgttgatttcatagt

SEQ ID NO: 107759 - DNA, 3341 bp, Homo sapiens
agcgggcggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaaacaggctgtcagtgtggatgagatgaggggaactatcactgtacataagactgattcttccaatgaacctccaaagacatttacttttgatactgtttttggaccagagagtaaacaacttgatgtttataacttaactgcaagacctattattgattctgtacttgaaggctacaatgggactatttttgcatatggacaaaccggaacaggcaaaacttttaccatggaaggtgttcgagctattcctgaacttagaggaataattcccaattcatttgctcacatatttggtcatattgcaaaagcggagggtgatacaagatttttggttcgagtgtcttatttggaaatatataatgaagaagttcgtgaccttttgggcaaggatcagacacaaaggttagaggttaaagaaagacctgatgtgggagtttatatcaaagatttatcagcttatgtggtaaataatgctgatgatatggatagaattatgacgctaggccacaaaaatcgttctgttggtgcaactaatatgaacgaacatagttcccgttcccatgccatctttacaattactatagaatgcagtgaaaaaggcattgatggtaacatgcatgtcaggatggggaagctccatcttgtagatcttgctggttcagaaagacaggcaaaaactggagctactggacagcgcctaaaggaagctacaaaaatcaatctttcactttccacccttggtaatgtaatttctgccttggttgatggaaaaagcactcatgtgccttatcgtaactctaaactgactcgtcttcttcaggattccttaggaggaaattcaaaaaccatgatgtgtgcaaatattgggccagcagattacaattatgatgaaactatcagtacattacggtatgccaatcgtgctaagaatattaaaaataaagctagaattaatgaagatccaaaggatgctttgctgcgtcagttccagaaagaaatagaagaactgaaaaagaagcttgaagaaggtgaagaaatatcaggctctgatatcagtgggtcagaggaagatgatgatgaagagggtgaggttggagaagatggagagaaaaggaaaaaaagaagggattcaaataggaaaaaagaaagtctccccagacaagatgattgaaatgcaagcaaaaattgatgaggagagaaaagcacttgaaacaaagctcgacatggaagaagaagaaagaaacaaggctagagctgaattagagaaacgggaaaaagatcttcttaaagcccaacaagagcatcagtctttgctggaaaaattatctgccctggaaaagaaggtaattgttggtggggttgacttgttggccaaagctgaggaacaagagaaacttcttgaagaatctaacatggaactggaagaaaggaggaaaagagcagagcaacttcgcagagaacttgaggaaaaagagcaagaacgcttggatattgaagaaaaatataccagtttgcaagaggaagcacagggaaagaccaagaagttaaagaaagtttggactatgctgatggctgcaaagtcagagatggctgatctccaacaagaacatcagagggaaattgaaggcctactggagaacattcggcaacttagccgggagcttcgacttcagatgcttattattgataactttatacctcgggattatcaggaaatgattgaaaactatgtccattggaatgaagacataggagaatggcagctaaaatgtgttgcttatacaggaaataacatgaggaagcaaaccccagtacctgataaaaaggagaaagatccctttgaggtggacctttctcacgtgtatcttgcctatactgaggagagtctgcgtcagtctttgatgaaactagaaagaccacgaacttcaaaggggaaagcaaggccaaagacagggagaagaaagcgttctgcaaagcctgaaactgtaattgactctttactgcagtaaatgttacagacttaaagtcacaataaaaattagtgatattctcatgcctggacaaaatctttaattaaaacagtgaagacttctctataatttcaattaatggaagttgtagatcaatgaataagactggaaataataatttgcttaagaacttttagtctacatatattaatataacattaaaattgtacaactggtgattgttcaaattgttgtactactactcttcaattgtactgtgcagggaagttgggggaacagttcatactatagagagttacagtttagatgtatgtgtaaatcgattagctatttatccaactactgtatatttaggtaactagaatttcaaaatagaaaaaaaaaaaactgtgtcctgttttgcacatagaaagaagcagatcagattgtcctatgttgcgctgttatatatgaatgtttggactgtacatctaaagaatgattccgtcctaacacccacccagcctgtttgaacacattctaattgtctaacatttgttgcattttaagtatgagatgactgatcttatgaatgttttgtagaaaatgttataatttaacagtctttgcgagtatacatgttttttaacaagttgaaaatgtttcatctgaacctttcctaacttttttttgccagtttgagttcaaatcaaatacaccttaagttctggtttcatgttctcttgaaacattgaattgtacgtaaatataaaggatctactgttgcggaaaattaagaagctaaatactgctcagttatctttgcctgcgtgtatatttttaaaaattcactctgaagtgttatggatgcttttctttgagttctaaattttggtgggaattactttatgtctcccagttaagaagagtctccattttccagaaaatacagctaagcaagaaaaatatcttttaaatactttgcctttaaaacactttttattttgtttttctattttaaaaataaaatattattttctgaatttcttctattgggtaatccagttagaccatattcctctacaaataaaaactatgttgatttcatagt

SEQ ID NO: 107760 - DNA, 749 bp, Homo sapiens
agatgaatggatgaatgtttgtctattttcagtttcattatttttatattttcatgtgtatgcatatatgcacattttaatggaagggaatacttgagcagtccctccaataaataaaatgcttgtgccttgccaatagataccaaaccagctcataaataagtactaagcaaattctcatctcaatattatgggtctgaaaaattcgcttgtctggtttacagttttttctttatgtatttacattttcatgagatgtaaaaagtaatcttagtttctgacaattggaagcattcattaaaaatattctagaaataaatatgttgatggaataaacttctaaaagtcggaaatagattcagatgcatttgacaatttagtttataacaaaaatagcattttaaattatgggaaaatagaaatcattcaaatagcaacgttgagccatttgactcatcatgtagggagaaaaaacaattcagaaatttttatctttttctttacaaaaataaattttaaatggattaaagatggaaaaccccatggaattactagaaaatattgatgacgttatttagagttacagggatacttctttgcatgaatcaaaatctagaaaatacgtgggtagatttaaaaatttgaatataaaagaattaaaacttcttaaagaatattaaaagcaaaactaaaaaactagaaataaatttgcaactcatctagcaaagggctaatttcatcaatgtaaa

SEQ ID NO: 107761 - DNA, 309 bp, Homo sapiens
ttcatattaactggtttccttcaaactccaggaacagaaactaaccctttttgtgatacaaatcagtgtaacattcccagagtttgtacttgaggggccagaattcttagcagaggctgctggcatagttaacgcttgggcagggctaagtcactgggaaactgcctgacatgatcagaggttcaggtgtgctcatggaccacacagaacagcctgagagtttgtagcacatcacaaagcttggtggacttccctgtgtaagagccaaaactttgtttaagaggcgggaaagatggaagacaaggactg

SEQ ID NO: 107762 - DNA, 154 bp, Homo sapiens
cctggagggcaaagtctccgcgtccccagctgagatcccaagggcttcaagaagtgttttctacatggaaagtgactttgtcaagtgaaataatcaatgaggtccttattgtgtgagggaacacagaataatttttaaggtaaaactatcaccg

SEQ ID NO: 107763 - DNA, 388 bp, Homo sapiens
acaaggaagaaaatattttgcagaagcacttgtcaactttagggtgcttgaaagcatacccgcattgctccatagaattaaatgtaaatgatcctgaaaacaagtagagtctctatgagaaaggtcttggttggcatagactcagtataatttgctgattctgctctttctaagtttcatttgtgatttctaatattgaaatcctggttatttgcaggtttcagttagtttgttataccttaaccacaagtttctacctctgccagtttctgtctcttatggcttaatttggtgagtcatattaggaaaagtcaatcagaaattaattaccaggattcagcttgtcattttgaacacttaaagtagtgaaataaaagttacatttgaa

SEQ ID NO: 107764 - DNA, 299 bp, Homo sapiens
tggagtctgtgtgggaatgtaattgtgtatgtgtgcatgtgactgtgcgtaggtgtgcaggtgagtgtgcatgtgtgttgtatgaatagacgtgtgtgcatgtgtgagcagtgtgcatgtgtaagtgtaatgagtgcatatgtggagtgtgtgtgcacgtgtgtatgtgattgtaagagtgtgtgggcgtgcatgtgtgtatgtatatgcaagtgtgtgctatgtgcctgtgcataagtgtgcatgggtgagtgtgtgcatgtgattgtaagtgtgggtgtgcatgtgtgcatgcctgt

SEQ ID NO: 107765 - DNA, 888 bp, Homo sapiens
catattggccaggctgttctcgaactcctgagcttaagtgatccgcctgcctcagcctcccaaagtgctggggttacatgtgcgagccactgagactgggcatgtttatccttttgggatttatttatttcactgacgataatgtcttcaaggttcatccatgttgcggcctgcgtcagaagtgcctgtttgtttttgttgttttttttttcatttggttttattttgttttgctttgcgttttcatggagtctcactctgtcgcacaggctggagtgcagtggcacaatcggggctcactccaacctccgcctcctgggttccagcgattcttgtgcctcagcctcttgagtagttgggactataggcacacgccaccacgctcgtttcattttttgcattttcagtagagacagggtttcaccaagatggccaggctggtcttgaattcctgacctcaggtgatccgcccacctcggtcttccaagacgctgcgattacaggcgtgagccaccgcaccggccagaagtgcctgccttttgaaggctgaatggtcttccattgtatgaaagaactgcagtgtgctttttcattcatctgtccacgaacccttgggttgcttccacattttggctgttgtgaataatgctgctatgaatatgggtgtacacaaatctgtcttccactcctggcttctaattctttttggtaggtacccacaaatgcaactgcgggaacatctgatcattctgtttctaatttttccagtacacgccatactattttcccccactccttcacggttttacattccctccgatcagaatcgagcattcctacttctctctagtctcaccaatgcctgtttgtttatcacatccatcctaa

SEQ ID NO: 107766 - DNA, 915 bp, Homo sapiens
gacagtgagcggagatcgtgacattgcactccagcctgggtgacagactgagaccctgcctctaaaaaagaaatttttaaaataaatacatttcagttaattacaaataaattagtgaaatgctgagaaaaatatatgaaagtaaatttaaaaaacagttcttcatttttactaagcctacttgtggctagtggctaccatattggccaaggaaggctatggaacatttttatcatctcaggaagtactattggacagcacaaatccatagttctcacttgatcctcacgataatcctataaaatgacaagttgtacagtattgtatccatagaggccaggagactaaggttccaagaggttaaataatgtatcttttcatagaacttgagctagagaacttcctctagaagcaaataaatacaggcagatgtaaatacaaataaataaagggttttatctacaatttttaaatcttacaatgtaagtatcttgaaggcagagatgttgtctacctcttcaatattatatgcctaatatctattgcagagtctgacacaagccgaacacttagttactactaattagagggataaatacgtgtagtttttggcccaaacagaaattacagtttaatataattgtaaaaatttggatgtctttaccaaaggaactgctgggtttaaagggttataattaaagttctggttagtaaaagaaggaagtttgaaagctctgctctctattctgcttgcactctctttttagtatagtcacagctaagaagcagtaaattttcctactccgtgatggattcagccatttgaaaagtttgcaatattctatgaacgtgtaggcactgtttccagacaataagtttcaataaaccattgctgaaaacacttattttgcataa

SEQ ID NO: 107767 - DNA, 469 bp, Homo sapiens
tgaatagctaaatcttttctttttaaaacaaataaaaaagattagggaagtgagatcaagaagagcaaatagttgaaaccacatcaaacttgaaaaggaaaaaaatccctatgctcataattgcaaagtgccttccagattaaaggcctttgcccgctgcctgcatgtaatttcaagactaattctgattttatccattggataaaaatgaattagctaaaatctgggctgtagagtgcttttaattcttaaggtagatctctgggtccattttcaaggaattaaatgtaaattacgttaaaaagtctttaaggaatttggatttaggggactcgaagttgtcaagtacagtaacattaaaaaaaagggtagacaaatataggtcatggtttgtctttgttcaatccctgagattcctttttaagattttaaatggaattaaagatccaatatttgaagttgctaaaaa

SEQ ID NO: 107768 - DNA, 306 bp, Homo sapiens
attcttagagtatcctgaacttatagaaatcttgttttataatagtatcttatgacatttgaacagcatgattttatttatttatttatatttatatatttatttatttttgagacagagttttgctcttgttgcccaggctggagtgcaatggcatgatcttggctcactgtaagctctgcctcccaggtccaagcgattctcctgcctcagcctcccgagtagctgggactacaggcgcgcacccctaatttttgcgccctgctaatttttgtgtttttaatagagacagggtttcaccgtgtt

SEQ ID NO: 107769 - DNA, 302 bp, Homo sapiens
gtatcagcgcaacagagctagacccttagtggtgggcactccctagaggccccgttgattgagatacaattcacacccaaatcatccggcgggttaccagaatgtggctgtctcagagcccacatttggccccagaagggcaaccctgaagggcaagctcatttgtttattgatgaagtttgtagacaacccatgactgaagactgtataaatgaaattactacacaagttgcacagatttttctttttcattttcttttgagacagagtctaactctgtcgcccaggctggagtgcagtgg

SEQ ID NO: 107770 - DNA, 379 bp, Homo sapiens
gatgaatgtaaaaacttgaaggtacaagagagtctgacatataaaaatttgaaggaagacttaagtatctggctgcaatgcaacaacaaagaagctagttaagagagaagctagtaagaaagaaatagtaagagagaagctagtaagagagaaatagagttttaccaaataaatagtacagagtctatggcactcctctgccacctccaacagggctggtgcttgcacccaccattggaggactgagggtgggtcagtgtggaacagctctacccagctttaccctatctcaggctgagaatggagcccaggccgctgtgaaattcattggcctgaggagcctagcccatggcctgaggagtcagaaagcttctccaag

SEQ ID NO: 107771 - DNA, 274 bp, Homo sapiens
gtgagcccagctgtgagaatccatcctcacatttaaaactgcttttataaatggccttcatttccttttttcctctctgcctgtggagctatcctgaatcctgttctttgatgctgtgctgtctgtgaggtgctttgtgatgctaccattttcttgttggactagttcacattaattttactatatcatttttatgcaaaataattcaacatcttgagttttatgcagtaagagaaggggtgactttcctaccacagtgagctctggttagtct

SEQ ID NO: 107772 - DNA, 258 bp, Homo sapiens
acttcattaaaataaattaaataatctctgataacattttagtagatagtattctcgtctttcttaaggcatgaaactacacttttcaaattaaaaaatggtattataggccaggtaggtgtggtggctcacacttgtaatcccagtactttcagaggctaaggcaggtcagtcgcttgagcccaggagtttgaggctgcagtgagttattactgcaccactgcacaccagcctgggtgacacaagaccttgtctcaa

SEQ ID NO: 107773 - DNA, 368 bp, Homo sapiens
tcatttgaggccaggaactctagaccggcctgggcaacatggcaaaaccttgtctctactaaaagtacaaaaattagccaggcgtggtggcataggcctgtgctcccatctcagcaggctgaagtgggaggattgctcgagcccgggaggcagaggttgcattcagccaagatcatgccactgcattccagcctgggtgacaaagtgagaccctatctcaagaaaataaaaaataaaaaaaagaagggcttcacatggtggctaatcccaaagtgctgggattatatatgtgagccaccgtgcctggctgaaatttttattaagtaaaacgtaagttcacttgctcattgccacagtcaaagaactac

SEQ ID NO: 107774 - DNA, 228 bp, Homo sapiens
atttttacattcatttcatgagtgagactggcctgtaattttccatttctattccttgtcagttttggtgtaaaggttatgctggcttcatataacaagttggaaagaattcatttttttgccattctccagacaagtttgtataagaaaggggcttttttttttttttttttttccaagtgtcaaaggctgtttctttgatcatccactttattccaataacagaag

SEQ ID NO: 107775 - DNA, 343 bp, Homo sapiens
atcatagcttgctacagcctcaacctcccaggctcaagccatcctcccacctcaacctcccaagtagctgggactacaggcatttaccattacagccagctaatttttaaatgtttttttgtagagatgaggtcccactatgatgcccaggctggtctcaaattcttggactgatgcgatcctctcatctcagcctcccgaagtgctggaattacaggcatgagccacctcaccaggcctagacttggattgtgaaaggcatctcaaccatgacacattccaaaggcaaacttcttgattgaacccgcaactttgcttagccagccccatttctccaccatgc

SEQ ID NO: 107776 - DNA, 476 bp, Homo sapiens
gaactgcaaaaatggaggaggtggaaggaagctctcagccggggcagccggcccctcgtttcaggacaccatggctgggaagggagaaggaggagagaagatccaagctgagcggtgggggaggccttcccggagctaaacggaaccaaggagtccctggtgggtttggctcacccccacgggggagaggtaccgccagggcctgtccctgctgttgttggcccgtggcggtgggcctgtggccaacagccatctttcccctgaactccttgcaagggttgggacgtgcctgccacacatcggctctgcacatgagcttccgagggggtctgtgggcgcccccagcagctgccggctcagcccccagctcaggagagaagtgtcctctggctggccggcggggaggcttcccaccacgcgtaggcatgtcccagctcccacaccactcaccccgggtccccctgcatgcggttggc

SEQ ID NO: 107777 - DNA, 587 bp, Homo sapiens
tgaggccagcgacagcacgaacccaccaggaggaatgaacaactccggacccgctgccttaagagctgtaacactcaccacgaaggtctccagcttcactcctgaagccagcaagaccacgaacccaacagaaggaagacactctgaacacgtctgaacatcagaaggaataaactccgaacacaccatctttaagaactgtaacactcaccgcgagggtccatggcttcattcttgaagtcagtgagaacaagaacccaccaatttcagacacaccaccatataacagttgctcaataaatgcttcctcttttcaatttcctttgctctagattttacatttggaagactcagctccagacttctttaactaaccaaattctaatttttcttcaaggttcaatgcaggaccccagttccatgaagcatctgacttcatctcccctggtctctcccttcctctctctgaatctctgaacacttaagagtgtgactcataaagcctagcctgtgattctactgatgcattccgccttgcattttttctctaagattttccatttgtgatgatctttgaggctcttaga

SEQ ID NO: 107778 - DNA, 700 bp, Homo sapiens
tgattctattctattatctattctacattttcagggaagccctgtaccagttcagctctttgaataggaattttctccctctctcctttctccagagaggacctctaggcctctctaccctctcccctgaaatcccagccttcaccatccaaggagtgcccagctagttccagccattgtcctgatcacaaacatttcggtaagaatgccatgcttgtcccttgagtcagactttcatcctcttcaatccaacccgttcattcacttgtgagttcagcagtcactgaacatctactctgtgctaggcaatatgctagatgccagtgacacaaagccaataggacaatattctgactacgacaaagtcagacttgagtagatagcatgtgctgtaaccaagcttaacgggcacacaggggagagcattcaaaagcagacccaggaaggcagggaaagcaaggaagaatgctcagaggctgtgatactcgccctaaaacaatgggagcaatttagatcataaactcatggaaagatactctaggcagaagaaaggccagtgcaatgcacataggtgaggaaaagcatcatatattctggcagcctcaaggatctccacttgactggagtacagtgtgcaagggtgagtgtcaggagataatattgcaagagtatgtcccaaattatgttacatggactacca

SEQ ID NO: 107779 - DNA, 238 bp, Homo sapiens
tgtattgtttttggggaatggaggaagctcagtgtggtgcaagtgtagcccaaggtggggtggaaatggtcgtggtgtgtgtctggggaggagggtctggcagaatttggattttgtccaaagagcagtggagaaacggtgatgggaagtgacgtggtcagatctgcattttacgaagatctctcctctgagggaagaatgaacggggtaggccctggctgttggtaggcagggtcct

SEQ ID NO: 107780 - DNA, 133 bp, Homo sapiens
cctcccaaagtgctgagattacaggtgtgagccaccgcgtccagcctaattggctaagagtttaataatgagtggctgttgacttttctcaaatgcttttcctgtataaattgatatcatgtggttttgcttc

SEQ ID NO: 107781 - DNA, 335 bp, Homo sapiens
gcagggagctattagggaggaggggattgagggatttttactaaggcagaggcaggtgatagatttgagatttgcaaagtcagaacttggagcccagttgaggaatagcattacaatgttagcagcgttgttaggcgagcacaagacttcacaggtgatgctagttcaccaaaatgtgaacccacattaactggttttccttttgaatgtgatggttccaagaggtttgcagtcagtggagatgtgtgaaagggcttggaggtggaaatctgggtaagaatgccaagggcattcctggtagattaaaatggtaaagcaagcaacagatctggaaa

SEQ ID NO: 107782 - DNA, 662 bp, Homo sapiens
gggatgcccagtgaggtgagaccctcatcagattggagtggcgcagccatttcccagtttggccccaccattgtattgctattttagggccctagctcctactttcccttttattggacccttttctgggcacctttcgagtagatggggtcaacttaccttgcacaatcactgtacttctttttagaccttgaagaaatcttagtaatcaccctatctaatctctaccttttcttcatgaagaaagaggcccaggggttttgggaataaaccgaaagagtcagaaccagcctccaggtctccaggttccctgtctagggtatatttcagtctttgtggtggttttcagagaggctctcaggattgctgaacagagaacaagaaggcagggatctttctgcacatttgggctggcttgggattagcagttacactgagggtggggaagctctctccctctgctgggtaagccagacacacagagggcatttggggtagatcgctcttcagaagaggcatggagatgtatatttgtttttgtattctctcctgttttctgcctaatatgttgcagttttcttagcagcccttcccaccatttacctaactcctcagcctaagtggctgggcaaagattaatgtcataacttcctagatagtga

SEQ ID NO: 107783 - DNA, 96 bp, Homo sapiens
acatacgaatctgtccacaagtgacagggactgaattgcttaaactgcaagctccaggttactgtaatcagaggccacatttggtattgcactcca

SEQ ID NO: 107784 - DNA, 192 bp, Homo sapiens
agtaatcttaagtgtctttatttgtaaagcagaattaatagtacttaataagatgattgtgaagattcagtgagttggtgctggagatgaggttagcacagtgttttggtacagcatacgtgcttgataatcaccaggtattctatttcttttggaagagggcaataatgagatgggctaaagccatcaggg

SEQ ID NO: 107785 - DNA, 329 bp, Homo sapiens
tgggtcatgtgtaatctgacagtttaaaattatacaaaaatgtgctgaagtccttgcgttcattgcttagggagtatctgtgtgcaagaggaacattatatgaatgaatagaaatataattcaggtctcagctatttagaaaaaaaaatgcttcttaattctcttaatctaaagatttcttctttatctccttttgctttttctccttgcactttgttaaagaaactattgttctgtaggttttcctgtagagtctgagttttgctgattgcatccccatattgtcatttaacatgaactgctaccttctgtatttcctatacattgat

SEQ ID NO: 107786 - DNA, 298 bp, Homo sapiens
agggtgagaatacttggccctgatcaccgatgtcctagctcactgccccagtccagtcagtagcagaagccagccaagaaaaccaaggcttggctgggcgcagtggctcatgcctgtaatctcagcactttgggaggccaaggtaggcagatcaccagctcaagagttcaagactagcctggccaacatggtgaaaccctatctctagtaaaaatacaaaaattagccaggtgtggtggtgcatgcctgtagttccagctacttagtaggctgaggctggagaattgcttgaacccaa

SEQ ID NO: 107787 - DNA, 552 bp, Homo sapiens
caaaaattaaaagcaagaatataaacccaaagcataatgactaaaatggaaagaagtaaagcagaattacattttataaaacatttgcaacacaaaacaaagccacaaaaatgcttctcctaaataagaaataccagacgctaaaaaaaaaaaggaaaaaaattaattttaggaagaatgcactacaattttagtaccatagactagttaaatatattagtggaaacagaaaaacaatggatgcttcagtaagtaaggtgtgaaatccaataatggaaaacacatttctctatactcctaacacttctgacaccaaatatgtgggttttccacactaagcaattttccagttctctatggacagcaacagggtgtcctacaatttaattttgatactactgtcccaaacttagcacagccctcacaggttaagggctcagtgccacaagagtgtccccacttcagttggcattcgccaagttcagacctctggtacttctgaccgactagctataatagatcaggggtttccaaaaccctttcctcagatat

SEQ ID NO: 107788 - DNA, 342 bp, Homo sapiens
tgtgcgggtgtggtctgtgcggctgtgctctgtgcggctgtggtctgtgctgcaatttatgttactaaccagtcgtgagtttaccttattagcttagcaaatccagtaactgcaaaggtaaaaaactgtaaaccaacacacaaccaaactattgtgaaatttcataaaattcaaataactgaatttttactatatagtacaactgtatttttatttcaatttttcaacatttttactggttttctaaataagagcttacatgtatgtttctgctaactcaggcagttcaaacgtatggtaagttctatccgttcattccatttcccagaggtaaccactctt

SEQ ID NO: 107789 - DNA, 458 bp, Homo sapiens
atagaatccttcattttttttacataaatattacatcttaaccttttcatagaagagcctcggttttctttccaaaggtataaaggcgaggtctgtgtttccataagcagagaacatttatcctctgtcctgcctccctctagaacaaaatccattgctgtcttaatttccagttttgattgtagctctcagtgtgagacctcccagtgctgtagagtgtgtttcctctatgaggctcactcaccacaggcataaagatcggggtgaatttcccagccgcctacatccgggaatctctcattcggactcagcaagatcatttttatttttgaccagaaccttataaataaatcacaaatatataaatgtgatagggaaggcgcccatcacaactatttgttcaaacaaatcctgggcccaaagaaggagtgaaaaattaacttcctatcactttattt

SEQ ID NO: 107790 - DNA, 829 bp, Homo sapiens
ctaattaaagctcttgatacaataagtgcccagtaaatgcaccctgccttctcccctctctgtaaatctcttggcctgtgtgggagggtctcccgcctctttagtgtcacagtctgctcccagcccaggttgtacctcttcatttcctagtgaccacctgacataagcttgccgcttctctaggcccaacccctgcccacccatgtcagttgaggtggtgccattcttttgccatgcatcacctatgcatacctaaggctgaggagaccagaacacctctaacctgctttgccaccaaacacattggttaaagggagctttgtttgctgaaggtttgttattggtgtgttgttgatggctaacatttattaaaagcttacttactatgggccagatgctatgccaagcaccttatataggaaagtatttgcatttcatgaattttgagatgcagtttttgaaactggagtgtatcttaaagttggtgtcttctcagtgtcagcaaggcagcagttgcaacattgctgttctcgtcgcctgtggatgtgcaaactgggtgtgctcttcccattgtcatcatttttgttgagtaatgtgcattgttgataaccacatgtgttcagtgtaagcgctttttaagatgccttcaaaaacattatactgtgatttggtattataataaaaggtggttttatactcagaaaggcagagcagtggggttaatttgatattagtaaagcacagatttgccattggaggaatgaacatgattttttacaaagcaggaggtgtttttttggaactaagaaagaaagatacccactagtaa

SEQ ID NO: 107791 - DNA, 775 bp, Homo sapiens
cttccatccatatgagggaacaagtctttcttgccaacctttgcaagtttccctgtagcctttaattttttccgcatattctgatccctgaagatgtcccttactttcttgttcactaagctaagcatgtaaaattgaggaccaatgtactgagcccccttttatgaagtctggcaattctgtgagcatccagtctgcatcagtgcagcaccctgagttagagctctttgttaggcatcatagaacaggaaggacacaaatagtgtccctggcaacaaagacttcagctcctcccagctcaggaggctttcccaggacatgtcatatagattcggctctgcacagctgttctgagaaatctgaaaaccctaagttgcactgttaacccatcatcttgttagccctgcccaggatgtcaaagggggaaaggaaatcaacatttttctgcattaaatggtgacttaaagaaagctacctccatatttgaccctgtaaatcccattaaaaacctgggggcctgccagaaagtgcctttatgcttggctctgtattagctttcgtgactttcctataatgaattgtagcttgcttgagtcattaagaagattctgacagggaatcagctggaatctgctgttctttgaaggactcaatttatctatgattcagtgcttaagcagtcaaaaggcttgaaggggtcagtcagggaacatagctcataactcttataggtgcattgacttttagtatatgcattagataaacttaagacaag

SEQ ID NO: 107792 - DNA, 411 bp, Homo sapiens
attcagtgcctaaaaatttgttaaaattactggcagtgcaggccctaggctgggcctctaggaataattaacataacacattcaactggcttgctaaggttaaatgctatctgtgcctccttcaggaagtctggaaatcaggaagccattatctcaagtgcatgctagaggaacacatcacttgagccaaatctgatgatcaagaatcatagccacaactgttggctccagggctacctgctgctgcagcacctgctagaatggtaccagtaaagtggatgccttgctctggccaccaccactctcccattggtggaatctaaattatatctagaaacctagctgcaagggagtgtgggaaatgtagttttcaactttctgtcctttatagaactggactgaaaagaggtg

SEQ ID NO: 107793 - DNA, 484 bp, Homo sapiens
tccccagagctgaatgtcaaggccagccaagaggtggtgatttcggtttattttacatgcagaagtaggggcccgggttacctccttctcttagaattttggggaaattgatagtccagtgactcctacccacttttgggtgaaggacgatttggaatttgaagtgtggggagacaggcctgtgaagtccgaaggactcactgggtctccagatcccccaactctggaatgcagtgaatacccacccccatgtttcagagcatctctcccatgtgttagacgtcgtgcagtcctgcattttggctgagacacctaaccccggtgcactcaggtcagagcgccagggcttcaggcagacagcaatgggtcacacgggtccttatagttccttcctcttcccaggagtgtcattttagattttacaacacgagcgaataaatcatctccaaaccaacaagatgtcaccttcaggctccccactgca

SEQ ID NO: 107794 - DNA, 939 bp, Homo sapiens
gttcctggcacatagtgagtgctcaaaatatgttgccaattattggtcagtagtgctttgaaagtgaagatcccatggtagggacagagatcagatgacaattgcttgtttgctgagaacttcctttgaagttttgtcagtggaggctgctctagaatgctctaagagaaaaggaagctctctgtattattgaaccagccctcaaacaaatcacctcttttatatcactgtcatcaagaaaaaaagactgctaatgattactggtcagggtagaagatttgggcccaggcttgaggtctttggattctactccagaaatttccaagacaggaagaatcagaagagcctctaaaccaatacttctcagtcaggctgggagtgctatagtgggccagggatctggggccaatctgtctactttctgaaaccagtccaagatcaggtcagcatagacattgagagtcagcttttggaaacctttataataatttgcagcgtaattttatgtctgttggatccaaatgataattttaaaaatggggcttgtatttgtattacctttacattatttcacttttctagtaatttatttttcttgtattttacaaaagcatcagttcaggtcagattgaaaaacaaaataaaacttgtcctttatttcagagagtttgagaattgatctagaaaaacgattctcaaaactatgtcctgggccggcagtatcggcatcacctgggaactggttagaaatgcagttctcatccctaccaagatcttttgcattagaaattctgagctaggtcccagcaatctgtattttaacacttttcaggtgattcttatgcatactgaagttttagttgtactgggaccatctccaggataagtgtaccttcttctaaatttattagaacaagaacaggtattatatcccaagct

SEQ ID NO: 107795 - DNA, 275 bp, Homo sapiens
ggagtctcgctctgtcgcccaggctggagcgcagtggttgcaatcatggctcactgcaatctccgcctcccatttgatttttcacaaggatgccaagtctattcagtggaggaaagaacagtcttttcaacaaatgatgctgggaaactggatttccacatgcaaaggaaaggttgaacccctaccccacaccatattacaaaaattaactcaacaacctaatataaaatatcaacaacctaaatataaaagctaaaatcataaaactcttagag

SEQ ID NO: 107796 - DNA, 371 bp, Homo sapiens
tgccataatagtgaaggaacaaaaggtgatttaattatttctgactgttctccttggtctcttttactggtgttttttttgaagtttgtgaccacaactcataagatcaaaaatcccaagttcaccatcacagcctatgattatttctataataatatttaaatatgcattataatcactcccttgtctctctttccaagagtctataagctctttttttttctaagttttgagaataaattatttcctatgcctatatttttgagatcgagcactttgcaggtaattaacacattttagtggaaagaatttaaaaaaatcaattagtggaatttccaaagattttcaaaattaacaaggtcaaaacaaag

SEQ ID NO: 107797 - DNA, 427 bp, Homo sapiens
ctttatgttttggacataaactggaaacatttgaagtccaacgcataggaaatgcagaataacatcttaaaaataaagagcctttttatttacccgctttcccattcttttacattgcttttactcatccttacctgtatgtcttagagatttttgctttttattttttttttttagagatttttatttttatttttttagacggagtctttctctgtcaccaggctgcagtgcagtggcatgatcttggctcactgcagcctccgcctcctgggttcgagcgattctcctgcctcagcctcccaagtagctgggattacaggtgtgtgccaccacacccagctaatttttgtatttttagtagagatggggtttcaccatgttggccaggatggtttcaatctcttgacctcgtgatctgtccacc

SEQ ID NO: 107798 - DNA, 270 bp, Homo sapiens
cggcctcaaatgatcctcccacctcagcctcccaaagtgctggtattacaggcatgagctgtcccacctggccagaagtttgttattaataataattatcagaggttgtatagggtcctatttgccccagttcagatgattgaggagggaatgctgcattttatgttttacttagaatctgcaggtatttagtaagtttgcttttaatgattaatagagggtgacagccctataaatagagtagagagaagatgccagtagcgatcatgg

SEQ ID NO: 107799 - DNA, 398 bp, Homo sapiens
atttgtgaggggtcctggaagcaatcccctgtggtttccaaggaatttactttaaatctaaataatggccttccaacatgtatatcaagcatgcttgtcacatactctccttctataataactgattataacatttattccaatctatatttcagcatactcttaaagagctgccaaattcaggggaagtttttagtccttttatcacaattttatcactgtgacattgctttaatgatttgtatgcctattaactccccacctgttagtcagaagagtagataactaaaaaaaatgtaagcagccgaacttaagatttcagaaaatgtttcatagctttctctattaaactgagctttaaaatctaacatttgagcaaataaaaacaatagaagctg

SEQ ID NO: 107800 - DNA, 433 bp, Homo sapiens
catatgatgaaatacagtttggccattaaaaatgacattaagtaaaaatgacattattagagatttactgacacgagaaaatgttcatgatatagtgttaatgaaaaagcagattacaaaacagtgtatagtatatgatttaatttttgtgcttatatacgtgtatgtaaaaacatatctatgttatgtgcacacgaagcaagtaaggaagatttagaaaactgtatactaaggggttaacagtatttgtcactcaagggtagaattatgcgtgatttttattttcttctattgtgttacctgcattaaacattttgtacaataaacatgtgtcattcttggggcctaatctaccagaaattccttgcatttttaaggagaagaaaagaaaggagctgcccaaatttatggagggggtaaccatctgattttt

SEQ ID NO: 107801 - DNA, 439 bp, Homo sapiens
ttcgagttccatgatgagataggtactattatgatttccattatgcagaaggagaaacaggattagagagtttaatagcttccccaaagtcacaaagatagcccatgatgactctgtgatttaaacccaggcagctggactccagatttattttttctttaccatggtcttctactgccctggtgaataggatggacatcacaagtcatatgtcatatatcccaatacacattcattcacatacatacacacacacacaaatacacacacacatgtacataaactaagctatggaagctgtttagaacatataacttaaaattttccccttataaaatattttattcatcacatttagactctgcagtaaaacttgtgaacagtttgccaactggcagccccggggtcatattatctgcacatcgttttatttggcctt

SEQ ID NO: 107802 - DNA, 600 bp, Homo sapiens
ttgagacggagtctcactctgttgcccaggctggagtgcagtggtgtgatcataactcactgcagcctcaaactcttgggcactagcaatcctcctgccttggcctatcaaaggctggtattacaggtgtgagccagcacacctggcattgactatggccttaagtgggccgattagactatgaaataaaattcctagcactgaatattagccctcatttcagacctaaatatcagttgttgtttttcctgaaccatcttccaaggatcattttgtaactgaggtcccagagttcccctttgatgtagaggctgttgatttcttttctggggcaggttctgatagcaacaagattgccagcctgctgaactgtggctaaggtattagatgtcaagatgaaactgtccagtgagattcctggagcccctgggaggtctagggttgggggtactggtgactagccctttcacctgagggtaggtggcagagctggtaccttcctgcagcctccaacagccatctcagccctgaggctgaagaccttgtctcttctctccttttcatcacttcctaccagagccctgtgggtgtagggacatc

SEQ ID NO: 107803 - DNA, 423 bp, Homo sapiens
cggtcagccactgactacgagaaatgtggaatagaggtgggtggggtggaaactctcccatgtcatcacagctgcccagtagaccccagagcatcctcctcatgccagaggcagaactggagagagaccaagattcagagacaggtaaagtccaagacagggaaagaaggaaatcagagccagttgcccacagagatgctgccagtgatgcccacacatgctcagcactttgactcctccacaagcctgttttacagacagaacactgaggccaagagaggtgaaaagaaatgtcccacatttgatggcccaggccaaggggattagtagaggggatgctgagccccatgatttccaaattcaacccagcaccactcaggctgagaaggagggattcaggggtcattgagaaagacagggatg

SEQ ID NO: 107804 - DNA, 181 bp, Homo sapiens
gagactctgtctcaaaaaaaataaaaataaaaatagagttgtaaattgtgtgaggattaaatgaaataatgtgtaaaaccatctagcagacaatttgggaagatgaaaaagtgctggagatgcatggtggcgatagttgcacaacagtgtaaatatacttcatgctactgaactatatacc

SEQ ID NO: 107805 - DNA, 635 bp, Homo sapiens
ttgaggacattgctcaaagggaagctgagataatggaccaatgggaggtcttggttggatgatgagccactgaggatggataccatggagtgggtgggagcgtagaaatcacagtgaaattaaagagctggcgtgagtgggctaaagtgtgaatgtgctggagagaaagaaaactgtggtccatatcagcaagtgcagcttaggaaaactacaatttaaatggtgatggagttcaatgccttggcagggtttggggtgtgatcatggaggcagttggctggaatggagtggaaatgaaggtctctgggattgaagcagacaagaaactgagaccagagtttcaaatgggcttctactctccctaagatgatgaaaccactcacgttgttgcactgctaccccctgaacctgtctcatccttccccagcctcctgtgtcccagaaaccagggttcttaccatgactgtaatgtcccctccttcactcatgggctgcagtcctggttcttggaggcccaaccctctgacaatgaaatcttctagtccttctcatcatccttaactgagaatgcctattctattctcactattcctcatagcccattgccactcctaatcctgctcatcttgaggtac

SEQ ID NO: 107806 - DNA, 485 bp, Homo sapiens
ttgaggacattgctcaaagggaagctgagataatggaccaatgggaggtcttggttggatgatgagccactgaggatggataccatggagtgggtgggagcgtagaaatcacagtgaaattaaagagctggcgtgagtgggctaaagtgtgaatgtgctggagagaaagaaaactgtggtccatatcagcaagtgcagcttaggaaaactacaatttaaatggtgatggagttcaatgccttggcagggtttggggtgtgatcatggaggcagttggctggaatggagtggaaatgaaggtctctgggattgaagcagacaagaaactgagaccagagtttcaaatgggcttctactctccctaagatgatgaaaccactcaagattttagcaggatttggagtggcaatgggcttgaggaatatgggagaatgactaggcattctcagttaaggatgatgagaaggactagaagatttcattgt

SEQ ID NO: 107807 - DNA, 403 bp, Homo sapiens
taaagtggaagtggggttggtgagtggagcaatccactgtccttgcctccaaggccacactgaccagggaaaagatagagtcagggctgcctgcgcagaggacttgcaggctatgcagacctctccgtctctttgctactccatctacccttgaagtctcgaggaaatcagcactagagagtattggacccaggtgaactctccaaggtctaagctgagacttggggcctagaaggtgatccaggtatgaagagggaagcagcagccaagcagagtgtttgctctgagtgctgagggtctaaaactgggaatggagtccatgctgattagaccccctaagctgtggatcattatgcaccatgcacatcctgatcctgggtagcagcaccctctctcaagcccc

SEQ ID NO: 107808 - DNA, 202 bp, Homo sapiens
aagcccttacctacctgcgtcctcgtgtgactttgccgggtctggcacctgctttcctgccaatcgatgggaagtggctactaactgatgctagctttcactggtaacgggaaagtcaacagcctctggccctttctgtgaaggagaaaagcagaaaagtgctcagaatcctaaaagggaaacagatcaaaagaagggtggg

SEQ ID NO: 107809 - DNA, 359 bp, Homo sapiens
tactagctgggaaagtcgtttatgttaaatgttcagaagaaacattagaagaaagttctaaacttctctacactttgtggaaaagtgggagttttctcttgagtcgacttttcctttccccaaaaccaaaggtataaacatattgcatcagaaatacttatactgcagaaaaacagatcaatacttctatcaaaaaatatttctctatgagttcaatttcataaagtttagtcattagcttaatggcagaatacagccttaacagccactgaattacactcttttaacacataaataaaaccattataaattatgatgcaaacaactgagacttccatctgtctcctcctgtttgccat

SEQ ID NO: 107810 - DNA, 299 bp, Homo sapiens
actacaggcgcccgccaccatgcccggctagttttttctattttagtagtgacggggtttcaccgtgttgcccaggttggttttgaactcctgagctcaggctcaggcaatctgcctgcctcagcctcccaatgttctagggttacaggcatgagctactgtgcctggcccagttagtgatttttaaattgtagttccttaaatgagtattttggatttcactccacaatgttcttcaactgtaagatctacttgaggttatttgatttgctggtttgcaagaactcgtctacacgttg

SEQ ID NO: 107811 - DNA, 343 bp, Homo sapiens
ttggatggacactgttcaatttccctgcttttataagaaaagaatctaatccttatctacataattggggtcacagcctcaggagctgaaatccaaaactacagtagtaggaaaaagaaaaggcaatagaacctttcttctcttgacacagttaagtgtcctctgggtaaaaggtcactatttccagataaaaagcaaatacacatttaatgtgatctcctccccattcagagatctttcagataagcgtagccaacgcctccttactgatgggtctatatacacattatctgggactctacagtgcctcagcctccgtagtagctgggattacaggcatgcg

SEQ ID NO: 107812 - DNA, 331 bp, Homo sapiens
tgagatcgtggccttgaactccatcctgggccacagagactgtcttaaaaaaaaaatttagaaatagaattacccataagatccagcaattctacttcaaagatctatatacccttggctacatatccaacagcagcaaaatgagtgatttgaacatatatttgtagccccctgttcatagcagcattaatcacaacagccaaaagcttgaaacaacccgtgtccatcaacagaagaatggagaatcaaaatgtgacataaggaagggaattctacgtggtagaaaacagatgagcattaaaggaagtgaacaatgtgcctctagcatgta

SEQ ID NO: 107813 - DNA, 716 bp, Homo sapiens
ctacataaaagatttagagaaaaaatttagaaatgtggattacattaaaatgatctattagacaatcacaaatttttaacttatattgtgaattatactaatagattagccaatagagaaatatgattactttgaggaggattacatatgctgatatttcactaagaatttttacatcaataatcataagaatggcttgtcactttctttaaacctatttgctttgccaccaattagccaccactattttgttgatttaaaagtggtatggtattccattcagaacttgctctcaatggcaaaccaactggccagtgccaaaggaagctaggctagactggaccacttgttcctataaagggactactatttccagagatctggcttactggtattctgaaacttgtctctgaatacttactaataaactccagggtacaatttattctagtataaagtacaaagaaaagaggatgaactacagggtgattttataatttatggatataagaaccaatccataccatgccttctccctgaaactaaccaagcaacctgcacaagttacttaacctctctgtgtctcattttcctcaaatataaaatggagatgataataccactaacagcatagggttgttatgaagattaaatgagttaatatacataataacttataacagtgattgtcacatagtaaatggtgaggtgtgtct

SEQ ID NO: 107814 - DNA, 463 bp, Homo sapiens
tattcctttctatagcaatcctgtgcccacataaaagctgcattttcactacaagataaaaaggtgttttgcaagaagtgcaaggtttttatgcctgctgacgcagctacagctcaacagctcacaaatttccttttcttttttcacaatggtccttaaactggattcatttatcttaaaatggcaggcaactgcagctgcagaacacagtctacaaaacatatcaagtaattcaactatttcttgtaatgtcatgacttctctctgtttcctaggagcgcttccaggatctttgtaagggctgacactttgtaagggtccaatggtgttattcaatgtctatggtattacactgaacatcatatacaagaaggcaagagatcactttttaccgcaataagcaatttactagagagaaaagaaaaacagctcggagcagtctgagctatgtgaactatgcagg

SEQ ID NO: 107815 - DNA, 317 bp, Homo sapiens
tacaaattaagatgtgcccatggcttagcctgcgctccatcctgggccctgcagcccactcccagggtaaccctctgcagacccaagactaatgggacaagggatctgctggggcagtgtaggccaaagctgcggctgggtccaccagaggccaagatggagactgacctggacatgcttcctgggcagctttggtggcagtctcccttctctatgcctcacttttctggcagaattttcaggcatttccaagcggaagggagggagagaactcaggcatcactttgaatgttctgccagtgaccagctttaaacaa

SEQ ID NO: 107816 - DNA, 264 bp, Homo sapiens
agtgccccatttttttttttcttccaagtaactaagttctgtgacttggatgctgtgacttggactttagaggtgaagtcagatgacaaaagatttccatgcaaatcatgtttccagaatcatccctcatgtgcatgtatgtctagtggaatgcaaggcttactagagggaggttgaaatttggtgtgcgttaaaggaaatataaaaatcctgcttaatgatcctgttaggtttgtatacagattaactgttattacacaagaa

SEQ ID NO: 107817 - DNA, 187 bp, Homo sapiens
  misc_feature (113)..(113): n is a, c, g, or t
ggtgggagaccagagttttaatcattactcaaatcagtctctatgaacattcggggagcagagttttaaaggataacttggtgggtcacctgtaactacctttacctcctgtngttctcaggagcggaggctggaggtgaaggtagttactggtgacgggcccagggcctgctggcaaatagcaagc

SEQ ID NO: 107818 - DNA, 601 bp, Homo sapiens
tgcatattatgtgtcattatgtatgctcattgtcattccagccactttttttcctcacttaagaacgcttattggaatgcaagtgaatgagagtgtcattgttagaaagaaaatcttgaatttttcaaaagtaaactatttgtaaatgtcacaacttgaattgtgggatgtcttgcttgtagacatccaaggcctctgttggatggcattcacgctggagtcttagcgctgagttggaataaataaaacatcctggtgggatgtatgaatgtgatgaggcttctcttagaaaccgcagcaccagagctagttgcgtgccctgctccaaaaccatggagaacagcctgccatggctttttctgcagaggatgttgaattttaatgattttaaataaactcctcataaccatcttcctcattttagttcagtccagcaggcacagactcctctcaatgcaagaaggataaacgcagcccgcagtgtcctcagtgggcctctgtgggaaattctgcactcaggagaatccccagaagagagctcttagggcctcctgagaaattaactccttgaccgcttacaagtgactctcaggtttccaaa

SEQ ID NO: 107819 - DNA, 363 bp, Homo sapiens
atggcacactgagaccagaaagccaaaaagatggtgagagttagtgctaatgccctaaattttggtcatgctctcatctaagtaagaaagcacgcggtggctcaagcctgtaatcccagcactttgggagactgaggcgggcagatcatgaggtcaggagattgagaccatcctggctaacacggtgaaaacccgtctctacaaaaaatacaaaaaattagccgggcatggtggtgggcacctgtagtcccagctactcgggaggctgaggaggagaatggcatgaacccgggaggcggagcttgcagtgagccgagattgcaccactgcactccagcctgggcgacagagcgagactgtctc

SEQ ID NO: 107820 - DNA, 732 bp, Homo sapiens
gggggcttcgggaatctgctaagctggtgcccaagttgcaagacaaagtcctctgtgctcttcccactccatcctccacatagaagatgtctccccaagagctgcactgcctggaactggggaggggtgatacaggcactcccttagctgccacagttggttttgccctgggttgcattccaagtccactgcctctgagactagtgcagcaccagcgtttgcctgaggactgcagtccttgtggcctgactgccactcaaatttattctgtgatccaggccactttagtcagctggtggggaagccccactggcctgaaactgggttcttctcgctggagttggggattcccctgtggcccactggtagtctgaatgctccctccataggcattgacggaattcctacctgtgttgtgttctgctatgacagagcagcactgagctccattgtaaagtcccccactaacttcactctctcctccatgcacatagactctgtctcctcaatgcactgcctggcattgctgtagtcaatgcaagactgtctctcctacattcttgaatgcctctttccttgataaaaagtacctggtttgaacataggtacttttatcactcacctgatctttttgttcttatgaagatgctttcttgcatggatggttgttcaatttagtgttcctgatgggggattattgctcagggttctatctggccatcttgctctgtc

SEQ ID NO: 107821 - DNA, 699 bp, Homo sapiens
gtgggcggatcatttgaggtttgaggtcaggatttttcaaaattaatgacagacaccaaatcacatatgcaggaagcttacagaacatcaagcaagataaaaaccaaaaaatctgcacctagaaatatcatattcaaactgcagaaaaccaaagacaaagagaaaaatctagaaagaaaccagttttaaaaccactttttttagagaaacagggataagaattatactgtacttcttgtcaaactacataaacaagaagaaagtacagtgaaatatttaaactgttgaaagaaagaaccactaacctagaattctgtttccagtatccagtaaaattattctataaaaatgaaggagagacagttgcacattgttaatgtgctaaatgccactgaattgtacactttaaaacggttagttttatgttatgtgaatttcaccctaataaaataagtgaaggagaaattcagacaaacaaaaactatcaccaagtagacctattttcctagaaaagttaaagaagttcttcagaaagaatgaaaattgtgtatgtcagtaaattcggatctacataaagaaaaaaaatcagagaaggaataaataaagctcaaataaaatatttcatttttcttagctgacataatagtaataatagaaaaaatgtattgagtgattatatcataagggtaagtaaaataa

SEQ ID NO: 107822 - DNA, 931 bp, Homo sapiens
ggcgatgtcaatgatttggtattttttttatcatattacatttatttttattaagacttttattgtttttattggtataatttacatacagtgaaattgacccttacagttctgagttttgacaagcatatacagtcatgtaaccaccacaattaaaatacaagacaacttcaatacaaaaactttctcttaacacctatttttaatcatcccggtcccctcacgtccacttaaccaatgatatggtttctttttgtacattcttgccttttctagaatgtcatgtaaatggactcatacaacatgtagccttttgaggctgacttcttacacttagcctaatgcatttgggatttctccatgatgttactctatcagtagtttctcttattgcatagtagcatttcattgtatgaatgtataattgtgtgttcgttctccagttgtggtatatttgtgttttgcagtttccattgattatgaacaaacctctagtgtacaggtttttgtatgaacataactttttatttcttttgggtaaatacttaggaaaagacttgctgtgggtcccatggtaattatttaagttttaaagaaatggtcaaattctctgtaccatctaacaccaccactggcagtgtataagagctcccgttgttgcgtatcctcatcagcacttgatatgggttgagcatcccagatctgaaatctaaaatgcaaaattcaaaacttttcgagtgatgacgtcatgtttaaaggaaatgctcattggaacattctgaattttggattttcagattatgggtgccgaactggtaagtataacgcaaatattcccaaatccaaaacatttgaaatctgaaacatttctggtcccaagcatttcaggtaaaggatactcaatccgtattgtcagatttagaaagaaaag

SEQ ID NO: 107823 - DNA, 141 bp, Homo sapiens
tgctgctctgtcctctgtaattcttataaattactatatagctctagaagccagatctgtttgtataggaaagggatggtatatggttaatgtagtgttagcaagtggtatccaatagcttttttaaaaaatatcatcatg

SEQ ID NO: 107824 - DNA, 129 bp, Homo sapiens
acagggtctcactctgttgcctaggctggagtacagtggtgtgatcactgctcactgtagcatcaacatccgggggtaagcgttcctcacactttagtcccccaaatagctaaggactacaggtgtgtg

SEQ ID NO: 107825 - DNA, 207 bp, Homo sapiens
taatagtaagaagatttctccatcaaagaggagaaatgtcatgacttctagaaaaaactttatggaaaaggggaggtggccagagcctactgggtcaaaacctcattcgtaggggctcttttaaacaatgagaacccttgagaactagtagagtgagcactcactcattacccggaggacaacatcaagccgttcatgagagatttg

SEQ ID NO: 107826 - DNA, 155 bp, Homo sapiens
cgcgcgcgctgtctctctcctccctggacctgaacctggttctctctctccctccccgcctaacccctctccgcagctcctctccctccaggtctcctccctggaccggaacctggttctctctctccctccccgcctaacccctctccgcagct

SEQ ID NO: 107827 - DNA, 573 bp, Homo sapiens
gagggcagtgcaccttaactccgtagggacagaacctctgcactcaggacccttccagacctctctgtatgtacctcttcatctggctgttcatttgtatcctttgtaagaaaccgctagtggccagtgttctgagtgctgtgagtcattctagcaaataatcaaacccaaggaggggatttgttggaaccccagacttggtagcaaagtcagagagaaatgtgggtaacctggggacctgacatttgtgagtggcaagtgaagcaaggcagtattgtgggactgagtctttacacctgtggagtctgatgctaaatttaggtattgtcaaaattgaactgcattataggacactcaataggtgtcagaattggtttgcgtcaagaagaaaaacccttgcgcaatctcataagccaaaaaaagatgttgaattgttttatttttgcatttccttattaatgtggacaaataacttttttcatgtatatattggacactgaagtgacttcttctgtaaactgtctgttcttgtcctttgctggttttcctactgaattgtttgtctttttctca

SEQ ID NO: 107828 - DNA, 194 bp, Homo sapiens
gactagtagcatctgactggaattagagggctgcaagagggaagcatgcagataaaacggcacagagacaggttcagataagaaggatcccataaaaattactcaattaccaaaatgaaatgatggcttcaaggcttcagtggggaaaaactcatttcagttgattcagttaagacatttaaaagaagacattt

SEQ ID NO: 107829 - DNA, 966 bp, Homo sapiens
ggagaaggaagaaacagccaggcctggtggctctcacacctgtaaaggaagaggaagaggaggaggagcaggaggaaacagccaggcgtggtggctcacgcctgtaaaggagaaagaggaggaagaaacagccaggcacagtggctcaagcctgcaaaggaggaggaggaaacagccagttgcagtggctcacgcctgtagaggaggaggaggagacagccaggcacagtggctcatgcctgtaaaggaggaggaggaggagcaggaggaagaagaaacagccaggaagggtggctcatgccggtaaaggaggagaaggaagaggaggaggaggaggaaacagcaggaaggatgccaattctgcgcttctcagtaactacgaggtatttcagttactaactgatctgaaagagcagcgtaaagaaagtggaaagaataaacacagctctgggcaacagaacttgaacactatcacctatgaaacgttaaaatacatatcaaaaacaccatgcaggcaccagagtcctgaaattgtcagagaatttctcacagcattgaaaagccacaagttgaccaaagctgagaagctccagctggtgaaccaacggctgtgactgctgtggagatccagctgatggtggaagagagtgaagagcggtcaaggaggaaccagattgaagctcttctcacaaccgtcacaggcattctgctgagagcagaggctgagcagaagacgataccacccgcatgtggcaatgacgagaggaccagtaaaaagcacagtgggccgggttaataagtcagaggctgcaccctttctggagtgagagtggattgatttatccctccaaggcggttgggtgtggctcacaaaaaaaccggtttttcgggaaagataagaggctcttttcacttgaaggacggcctaggttagggcaacaaaccaccatcccgttatgagttccc

SEQ ID NO: 107830 - DNA, 116 bp, Homo sapiens
cccagtaatccctttccaggggcctgtctcttccaggccctgcagtggcctgaggtctgggtggggcctcagtgggggctggggcccctgaggctctcgaagccacttcccctgct

SEQ ID NO: 107831 - DNA, 231 bp, Homo sapiens
cgagagccattagtgccacattgtgtggggtctctgcatgcattgcgtagggggtagcaggcagagaccttcagagctggttggctggcctgctccgtgggcagccgggcccactcacgcactgtgggccacaaagattcatgtttgtgccttggcaaaattatgaatggccacgtatcaggaactttagaggtgcttaggaattgtcagagcttatttcactcaagactg

SEQ ID NO: 107832 - DNA, 413 bp, Homo sapiens
ctgggggtgggagagagacagcacaaggggcgtgagccaggggcacgcatcatgcagggaggaggaggaggaggcagaaccgatgggctcctgggatgaggcagggtgtgctgtcagcgtcccatttacagagaaaacgtgaggctcagcagataaggggggctgaggggagtcaaaaagcttggacgcccaaccaggtgcgtgctcctcgaccttcagctgttgccagggtgtgagaagctgaagaacctgagctgaggatgaaacttgcttgtccctgttcctctcaggcacagctccactgtctcacccacccatccacttgcatggtaaaagccagtacatgtgcaggggatgttggcgtggctggaggtagcagcaccaaagccagctccacacacttggagtaataa

SEQ ID NO: 107833 - DNA, 362 bp, Homo sapiens
ttggtccccttatccccgagaaaccactaagagaaccttcaggtctccccagaagccgaagctgaggaactgggcttgccccagggcatcctcctgtgaagctccttggtctccgccacgggctccaatcctgttgctggagcttatctcctcagtgatttacctgccccctgcttctggtggaacagtgagtaactgcccaaccagaaacctacacacacatattcaacacagcgcctgcaagcttccagctcacctggacctggagtgatccccaagcatcctggggtcaggcacagaaacaggaacagcgagctcctggctccagtgctgaatggggcacagatgcattaactctccca

SEQ ID NO: 107834 - DNA, 733 bp, Homo sapiens
aaaacatttatttctattttagggaaatcagtattgtggtgtatattttctgttactattttcactggaggaaaagccctcaagtaggccacggaattgtggaaagaaagtgtaagaagatttttcccctcatgacaaaggacaatcctcccctacaccttggtgtatggagcacgaaggctgctgagaaagagggtaggcagtttttattaagagccaagaaacttcttgggaagaaagaaatcaagaccctgacacactttgggatggggttggggacaccgagtgtatgttatgaacagttagcccttgtagatcaatagacaggaaaggacaccaagcaaactcaccaaaacccaaagagaaactaaccatgagaaggaagagagtcaagttctatgtaaacaaaggcttcactagtgcaaaggaggagctagtcttgagctgacagagaaacaccctctgcccactcaacgctggaacctgggtattctctaggaagatagccacctattttggtgtaacctagggattctgtgtcattttaacactacaggaatctttctttctctgatcttgaagaatgactgtatcttggatctgtactgatggttccagaagcaatgggtaaagggagtacaatttctagcctttcctgttggcaaccaaggtttcaggggtccgtgacagtgtgttttagcacatcaactggacattctaggatgccttattg

SEQ ID NO: 107835 - DNA, 438 bp, Homo sapiens
tcccccttccagcagccatcagacgcactcacttctcatgaaggagacagaggttcattttcttgagacactgaatgatctcagaggaataaaccctaaacagattggatgcttcaggttttcctcaagaaaaaggctggctagctgtcctgtcactctccatggagctgcatcagtcagcaagcctcagttacacaaccaggcctttcattgaggtttagtatttctattattaagtactagagcagtattagatttacagagaaattaaacagaaaatacagagaattcccttttaccccttctccctcccacactcagttttgcctacggttaacatttttgtattagtgtggtatatttgttacatttggtgaattaatattgatatattataattattaactaaagtccatagtttacattagcaatcaccct

SEQ ID NO: 107836 - DNA, 152 bp, Homo sapiens
gaatgaacctcaacaacatttataccaaatttttaaaagccagacaaaaaatgatcacgtatcatatgactccacttatataaaatgtccataaaagtttataaaataaaaccattattcaatggtggcctggggctggaggtgggactagg

SEQ ID NO: 107837 - DNA, 338 bp, Homo sapiens
tattttatacatgtatatgtggccaatctgaatggaatacttctgaacaacagcaaatattgatggtgcctaaatttttagaatcccagaaatatcctcttttgcaaatacctgaattcattcctgccggcaaatatttgttaagaggctactgtgggtcaggcactgcagtaaaccctgaggactaatggagaagaaaagagttgaactctgcttttgtggcgcttatattctagagggaaatatggtcaataggaaggaaatagaaagttacatatagtggtaagttctatgaagaaagtcaacatggtgagttaataaagaacaggtcgggggcg

SEQ ID NO: 107838 - DNA, 376 bp, Homo sapiens
tatcatttttatacccctgttttattgattccctatccaccagaatgaactccaccctcccattagaaggcagagaagatggctccagccccatcagatctcaacagagtgcacacacacagatgttgacttggcaactgaactaagctcatatttaactagctagagcccaaacaatttctgctagttccctctgggtgatcagggagagtcaccacctcccaacctccattttctcttctgtaaaactgggcaagtcatacctgcagtaaaccatggcaagcaatgcacaaaagtgccaagcctggagctggtatgtagtaggaacacgtattagctcccctttccaggcaccacccatatattccattcctct

SEQ ID NO: 107839 - DNA, 126 bp, Homo sapiens
cctcccaaagtactgggattaccggcataagccactgtgcccagccctgtagcattatttctaacaacaaacaattagaaaaattaaacactgcctattctttttttttttttttttttttttttt

SEQ ID NO: 107840 - DNA, 177 bp, Homo sapiens
ctgtaatctagaggatccagacaatgctggtttacattactctgacaggatgttttacacggccagagtggatgtggatgcttctgagaaatgaagtttgggcttacccacccatcttgagagttcttaactgtgtgtgccaatatgcataggaatccccggtcgacagaaaaatcc

SEQ ID NO: 107841 - DNA, 833 bp, Homo sapiens
ggttaaaactttttcaaattcttacctgtattaaacacttaacctacattctcctcttgtaatcagaatctcgtgtgcatgtatgtaatgatgggttctctaatattcagttttctggcagattaaaacatctgacaaaactaaagaattattttaaaaatatttagagtgtcaacatattcaattcttagatggaataatgatctttaaagagatgagactagtatgtaaaaagttcatttttaaaagtaagaatcttcatcctaattatctgctagctaagacaaaataatagaatcaacattcttacagattttcgtttacactgcctcctttaaaagatgcccaatactgtggatattaaagagtgattactagtatattatgtatattatatattcagctttccttttgtaaattgattttaaacatttccaagaaatagtttcaaactaggtacttcttaacatctcttatacttttgccttaaataaaaacacattgataatgctaattatatggtaaaactgttaggtctgcagaagtcatattttatttctgaaataataaaaatacattttaaaacagatgcagaaaatgtgaaaggtagattgctgctggaaattcacatagtctttaaggaataaactatgtacgtgttgactatgaacagactagtctatatttactatattaaattttcaccaagttataaagattcagtatgttatccttttggaaatttaaaaaatagtaaaacacattctttttaagagcaggaacaatgtacttgaagcaacaaatttatgactgaagattatatatcagtataa

SEQ ID NO: 107842 - DNA, 301 bp, Homo sapiens
cagtttcattgcagcggagtgaaatgctgccacctgcatgctgcagcccagcctcccctcacaccagactcttggggaaagaataccttagccccttgcagtatcgctatggacagacggtcctttgattgagctgactttacaagtggctcctttcatccatcatgtgttaaatctgactagtgtctgtttgagtgtaccctttccttgtcccagcataatcatgatgccacaaaaccaaatcttcccactaatgggtcagacagaagaacgtagcctgtccctgacaccagaactgcca

SEQ ID NO: 107843 - DNA, 297 bp, Homo sapiens
ggccacgttcctcttagcgtgaagagactcaagtttaattagaaacacaaaaatgggcatggttggtggtgtggacaccaagccaatgatggaatcactttgattggtggtatggacaccaagccacagatgaaatcaaacttagcttggcaattcaaggctctatctaacttgatcacaatctacatgattattgttactattttgtatttcctaaggtaccatctattcactaaggaaaaagtacagaaaattcttcatccagagaaagacactctttaacattccctcaaatta

SEQ ID NO: 107844 - DNA, 371 bp, Homo sapiens
cgtccttcctgtaggaaccctctcatcccagctgtacatggtcagcattcaaagccttcttcaaatccttcctatgcctcaaagtcaagttttcccacagtcttccctggcactctcctccacaccccagagccccacagtgtccaggcttcctcagtctactctcagaggctgactgcctgttctgcaaggctagaccagcagcccttgaggagacatttcaaaatctgtgtgcctgggtcctgcctcccctcccaacccagggagtctgatacctgagatctaggaagaggcatctctggatacgttttgctggaggttttttttgtgtgtaaaagttatatttttactgaaaaagcaatacatgtatg

SEQ ID NO: 107845 - DNA, 341 bp, Homo sapiens
caatttttaacttattaaaacagaatcacaggttaaccttacatcatctataatacacacatacagttccaaaagatatacaatatttgaaaatttaaaacatatgtttaaaaaatatcagaaaatatttcaatcaaattatatataggatagacattttatttcacataaagggaaattcaaggcaacaggaagacctaaagcacaaagatgtttcttatacactggtaaaagaaacaatatgtccacaggataaaagccaaagttctaaaagtaaaaacagcccacatgatctgcaacttcctccctttcatcactgacctcctttcctactactcttc

SEQ ID NO: 107846 - DNA, 390 bp, Homo sapiens
ggcttctaacattgtatgcccacctatatttcatcaggctaacaataattttgatggctgatctgctgagagaagattttttttaagagacaggtcttactctgttgcccaagctggagtgcagtggtggtcatagctcaccataacctcaaactcctgggcttaagtgatcctcccacctcagcttcctgagtagctaggactacaggcatgtaccactgcacccagcacaagatggtcttgattacaggcatttatttagggatacaatttaaaatgactgacttttataaccctatcactatatatcaccatattctaaatgtctagggaaaagtagggggaaagactggattaggccaggcatgattaccagtaatcttagcactt

SEQ ID NO: 107847 - DNA, 341 bp, Homo sapiens
acctaatgaactaagagtaaaatggtcttgtgaattttctttcatttacattttcagttattttgtatagaaatttaataggaacaagaagtcagaagcagattagagacatgcaaaacttaaactcctaaccagagcatttggctgtgtagactactatgcactgcactagtgttttgaatctaaacctgtttagtccaggcgccgtggctcatgtctgtaatcctagcactttgggaggccactgtgggcggatcacttgaggtcagaggttcaagacctgcttggccaacgtgatgaaaccccatctctactaaaaataagctggatgtagtggcacc

SEQ ID NO: 107848 - DNA, 378 bp, Homo sapiens
aaaaattaagacaaagggtattactgagaataggatggtgctctggtttgaatgtgtttccaaagtttatgtgttagaaacataatccccagaacaacagtattgacagatgggaacttgaagaggtgattaggttatgagggccctgctgtcatgaatgaattgatgttgttatcatgggagtaggtttcttgtaaacactagctcagcccttctcaccctctcttctggctatgtgatgcctttcaccatgttatgacatagcaagaaggccctcactggatgcagcttgccccttgatctgggacttcccagcctccagaaccatgagccaaataaatttctgtttattataaatcttccagtctcaggtattct

SEQ ID NO: 107849 - DNA, 356 bp, Homo sapiens
tgttttagtgatttgggggataaagcacacttgtgctgattgctggaacttcccatcaatcagccaagaatgctctgccagtgggtgagagtctgtgaggcaggagagattggggaattcccctgtatggtaataggtgtatgaggaagaaatggtgggggcatccaggccatctggagcaaagagaataaagtcacaggtgacattattctctttgctccagatggtctgtctttccccatcccttgtcctcttgcacctattctcaacagagcagccagaatgattctgctgaaacataaatgagtcatatgtgtcagtcctctctcaaattcttcagtggcttcctttcttgc

SEQ ID NO: 107850 - DNA, 365 bp, Homo sapiens
acctgaatgaatgtaggcaagatcacaagaaaatttgaacagtgtttgaaattaaaagaacagccacaacaacaaaacaaaaaacaaacaaaaaaacatagacttatgcttccagaaaggtacttctggaaatagatgtccttttaaatgtccttctccacaatcctcttgctaagcccaactaaaatccctgggcataacatataaaacaaatatatgagcccctgaaaggtgaagagaaggcagacaagcaagaaactctggagacacagtagtgcttttactgggttttcatttagcttcatatatcctagagttggaaccaaagaaggtcggaatccagaaacaaaacagcagacaaaata

SEQ ID NO: 107851 - DNA, 726 bp, Homo sapiens
gcacttatagtggataattcatttgaatttgaaaaacatagaaatgaacctatcaaatacagagagagctatggaataaaagtattgatgcaatgaagagagttgaagagatcaagcagaaatgccaagcgaaatttataatgaacagattgaagaaaaagagcgacagaaagttcaggatatcaaagaagtcaagcaaaacatccatcttatccgagcctcttttgcaggcaaagggaagcagttggaagagaaaatggtatagcagttaccagaggatgtggatatggaagatgcttcttaaaaatctctgtaaccatttcttttatgtatatttgaagatgccctttggagacttggaactgctaaattattagtttattttttacataggtcacttaaatgaaaagtgattaatatatctttcctacatttccatctacaaaacatcagatattacggatattagattgcatctcagtgctaaattttcactgatagatatacttaatgtaaatcatgaaaattctacttataactatagaagtgaattgtggatgtaaaatggttatgccatttggataatggcactaggcagcatttgtataataactagtgacaaaaattcatggctagtgataaaatattatttacagtaaaatattccctttattaatattatagaaggggggatacaacaagaaactaacaatttgtatgacagtg

SEQ ID NO: 107852 - DNA, 401 bp, Homo sapiens
ttggggtgcgcggccgccgctgtttttggtcaagatcagaactggggagcctgggtgtaaatcgctgctgggccacttaccagccacgtgaattggggaagtcacttcacctttcgtgcctcagtttcctttctgtcaaatgggggaaaacaacattctctccttacagttgttgggcaaagtaaattgtaatctacctaaactaagccctcagagtagtccctggcacataatcctctaataattcattaatcactcagaattattaattaggccgggcgaggtgcctcacgtttataatcccagcactttgggaggccgaggcgggcggatcacttgaggtcaggagtttgagacgagcctgggcaacatggggaaaccccatctctactaaaaataca

SEQ ID NO: 107853 - DNA, 463 bp, Homo sapiens
acctgtttataatgacctgagcttggaacccaactctgttttataaataaactcctttttgtgtgatcttaacatatgttcagttatccaggaatgcaaatcaagggaagactaaaatttactttgttcaaaactttaacaagactcgatcaccattttggaggtaacatcggagatggcaacgtgacttgtgattgagaaagaagaaattaacccagatgcctgtggcaactaagaattttgcttgatgtggcctggtgcagcagctcatgcctgtaatcccaacactttaggaggctgaggcgggaggattgcttgagcccaggagttccagactagcctgagcaacatagcaagaccctatctctacaaaaaattaaaaagttagctgggagtggtggctcatgactgcattcccagctacttgggaggctgaagtaggaggattgcttgaccctgtctc

SEQ ID NO: 107854 - DNA, 458 bp, Homo sapiens
tggggggagttagattgaattaggctttcctctcaagcactggagcttttaattaacgtcagtggcagcaaaattcatggtggaagaattctttcaacttagcagcaaataagtctgtattaatctacctgttaacctgtgttctcactatatgcatgagacagcacttattcacgagtatgacagggtatagaatgaaagaacttaatttcataaattttttaaacttgcaaatacatgctaaagcctgtttaattcctggtgagctaataaagtaaagatgctagaagggctttaacttggtgtaatatcaaacaaatggtctgcttacaagcatgaagctgttggtaaatctctaatctcaggaaaataatgcagtataccattttttaaagagatgagatgaggctgattatggatatttacacttttacaaggccctttagtttcgtattttc

SEQ ID NO: 107855 - DNA, 408 bp, Homo sapiens
aacacaaaggtgcaagccattctcctctttgtggattcttattaagagagatgccggtggagaggggtgatcacggtcgcaaaatatatacgccaactgtattactctaggtccctgctatccatttcctgtaacttaagttttcaaattcctacaaacaagaagaaaatcctttgttcttcattagtaccaaggctgaattgatactgctgatttatgctcatctgaaagcgcagactttttttttttttagctctagaaaaacaaaatcaactccttgggaaggcagccagtctcctcaggcacctttcttggcagactttaccaatttcagaagaacccaccagttgggaagaactggttgaatggtctgtcctctgtgaaactgtcattagaaatgggctttgg

SEQ ID NO: 107856 - DNA, 238 bp, Homo sapiens
ataccttagcaatggataccatttacccttgctatgctactgtccaaagaagatatctggcatataatcagcataaaatatggatgaaagaatgactgaatgaatgaagcaagtgtcagagctggtgtgtccactcacaaacagcttttctagtttgatgctattcagcaaccccctcctcctgtagtattataaccaacatggtggaattagaaaagtgacatccaagacattaggg

SEQ ID NO: 107857 - DNA, 373 bp, Homo sapiens
ggcagagatgaccacagaggaggatcactcagaaagcattttctcaaaaactataatttctttagtctcctgttcaggtggataattaaataaatggtgattttcccaaaatgcctttagaaatggtggtcctggctggatgtggtggctcacacctgtaattctagaactttgagaggccaaggtgggaggattgctgaaggccaagagttcaagagcagcctgggcaggacagcaagaccccatctctaaaaaacaaacaaacaaaaattttaattagctaggtgtggtggcatgcacctgtagtaccagctactaagaagactgaggtgggaggatcacttgagcccaagagttcaaggctgtagtaagc

SEQ ID NO: 107858 - DNA, 295 bp, Homo sapiens
agaaaatgtcactgaactctgcctgtcaattcaagaacagaaattcaatgtaaacttctgccccaaattgtgtatttcccaaatgtggatcaactccctggtcacaaacacactgtaactgctcttgcaatgacagccacctcagcgcagcactcgcctggttgagtgactcggccacaggagctcccctgcgttctctaacacggcacttggtgtttactcctgccctttgctgctgtcaactccatttcactttaagcttggtgtggcagagagagtatgagctctgaagtca

SEQ ID NO: 107859 - DNA, 450 bp, Homo sapiens
ctgtcctccagcaccatgattcggttgggaacagaggaaggcgaggagagccatccgcttcctgcttctgcagcattcggccatttgcccaatgctccctgatgccacggttctcaaagtgtggtccctgtccctggcctgggagcatcagcttcctgtggggactctagaaatgcaagttctccggccccacactagactgactgaatcagaaactcggggcggtggggtctagcgatctgtgcgttaacacatactctagggggttccgatgcccctcgagtttgagaccctctggtctaatgatttatgggtgagacactctgcgcctgcttccctgaggaccccgagctgcagccccagggcttccccctcccactttgggtgagtatgagcagggcccaggtggctggggtgcagtgggcagcccggtggtcctgcctggggtct

SEQ ID NO: 107860 - DNA, 402 bp, Homo sapiens
ggttccctttctccatacccttgccaatggtggttatcttttatttttttttcatagtaaccatcctaacaggtgtaaggtgatatctaattgtgatattgatttgcttttctcagatgattaatggtgttgatcacctttcatatacatcttagccatttgtatgttttctttggataaatgtctattcaggttgtttgttcatatttttattaagttatttgtttctttgctattgaaacgtaggagattttgacaaaagtcaacaccctttcatgaaaaaagggctcaacaaatgaaggtaaagaagaaatgcatctcaacacaatgaaggccatatatatcacgctcacagctaacatcatactcagtggtgaaggacaaagtttattctctaatatt

SEQ ID NO: 107861 - DNA, 360 bp, Homo sapiens
tccaagacaggatctctgtcccccagactggcatgcagtgggggcagtcttggctcactacagcctcgacccccgaggttcaagcaatcctcccacctcagtctcccaagcagccgggactacaagcatgtggcaccacacctggctaatttttgtagagacggggctttgtcgcagcctaggctggtcttgaactcgtgagctcaagcagtttgcctgcctcggtctctcaaagtgctgggattacaggcatgagctaccatgcctggccgggcagtgagagaccctgagagtttgacacaggtgagtcgccatctgactttttttttttgagacagagtcttgctccttcactcatgc

SEQ ID NO: 107862 - DNA, 589 bp, Homo sapiens
cttccgtccccagtgcctcctgatgcttgcaatctcattcccaattcaccagcgtgcgtgaatgcagactccagatccagcgcagacgccaagaattcgctcaggggcaccagctaaatagcaaacagatgccatgtcaaacatgtgaaagcctcagcgactagggtaccgccgggaaaaccagttccagcccaggaatttctgggtggaaacactggccgccgaattgttttattctctttgcttgattcgagtcggttctgaaagcaggtgtcccctctcccccggcttcaggaagggaaaccccggccccaggcagttgcagagctaagaaaaaccatcccgccaggccccttcttgtggtaacgcggtcctaaccctgctctgccccacaaccccatttcacccgggagacgcagacgccaggctccctagcactttgtcgcctcttcctccagcctggcttcctgagctctggaaaagttccgggcctccggacgttgtttccatcttcgccttcgctgcctgggccgcatgcctcctgggcttatttaggaagcgaagttagcgccacacatttggctccaga

SEQ ID NO: 107863 - DNA, 685 bp, Homo sapiens
gccaggcatactggtgcgcgcctgtagtccaagcttcttgggaggctgaggtgggaagattgcttgagcccgggaagttgaggctgcagtgagtgatgattgcaccactgtgctcaaatctgggcaacaaagcaagaccctgtgtctaaacaaacaaaggaaatgtaaggatgcttccgacagcagctgcagtggtgttggtggagccagtgctgtccagggaagccaggcttgctgcaatgtagtgtaactgtttcttatcactgctgtaacaaattgccacacatataggggctcaaagccacagacattagccaggcacagtggctcatgcctataatcccagcaccttgggaggccgaggtgggtggatcacctgaggtcaggagtgtgagaccagcctgaccaacaaggtgaaactccgtctctactaaaaatacaaaagttggctgggcatagtggcgggcgcctgtaatccctgctactcgggaagctgagacaggagaactgcttgaatccgggaggttgcagtaagccgagatcgcaccactatactccagcctgggtgatggagcaagactccatctcaaaaaaaaaaaaaagaaaaagccacagacattgattctcttacagttctggagaagtccaaagttagtctcactgggttaaagtcaaggtctcagca

SEQ ID NO: 107864 - DNA, 346 bp, Homo sapiens
tcagccctgtcccccttcttctcacagtagctggagtgatctttccagaacataaggtaggaggctctccatgttctgatcctgccttcctgacctccccagcctcatctctccctcctctgccctcgccctctgtgctccagccaacgtggcctgtcactcgtccacctgccatactgtcctgactccaggcctttgcctgtgctatggcctctgttgggaccactcttgtctctcccctgctgtgtctgctaattcccactcgtgtcagtgatccatggctgcagaacacaccactccatccatggaaaacaatcacaatcattgattactatctctccctggg

SEQ ID NO: 107865 - DNA, 843 bp, Homo sapiens
tggtagataactcttgctatattgcctaggctagtctcaagctcctgggctcaagtaatcctcctgccttggcctcccaatgtgcggggattacaggcgtgacacgcatgttcagcccccctcaaccattttttttttaaacttctgcacaaacatctttactaccctcttcatttcattctgttcgtcatattcttctaagtttcattcactttatcttcatgtgtctggtttacaactggactactctgagaaacttctgctgtatttaccatgtaacaaaaagatgttttccatagataagtatatattctatacattcattctttggtatacagtcattctttggtatctgtggggggattggttccagtacctcccattgatatgaaaatcgttaagttctgccttggcctcccaaagtgctgggattacaggcatgagccaccgtgcccagccatggattcttaagagtttccattttaaaggaacaaaataaatattgcgtattcaagatttatgaataaaatatgatttaaattttccttacactgtaatttagggtatcaacatatattacaaatatttgcatattgttaaacatataataatttttatttatttattaatgtattaggcattttgtaaaattcctttgaacaagaagctccttgaaggcagaaactatgttctgtttcattttgactatctcatacctaccacagtgcctggtatataacaggtatgcattacatttttattcaacgaataaataaaaatttcctcactataagaccaagttcgaagtgttgagaaggccttaaaagacatgaggtatatact

SEQ ID NO: 107866 - DNA, 2109 bp, Homo sapiens
gtttgagcagcattgttagagcctgtggaaaacactttacaactgtgtaactgtcttcatctttacagaggaatagtctacaaaggaagacttgtaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatcatttg

SEQ ID NO: 107867 - DNA, 811 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtgtggttgcacaattcccctctgccttcctgtggggtgtcatcatagcctggtcaatgagaagttgggtaacttcccagagggtcacggagggagtgggtggccaaggcaggaagaacagaagccaaccccgcccacagtgggaacccaggcgttaggagatgcttttgacaagttataataagggagagatggtagtaaaggaagtgaagaagcgacgtgaaattgaaggaaaagaaaatgacctgccttcttaccgcggttggaatacacacccaaacgagaggtagcagagaagcaagcagtgcattctgttaaaaattattgtgtcctcatttgagagaggagggatcctcaaataatacaactatgtgcaaagcaggaagtgaaatccttctcagtcctctccccagttgtaatccaagccttccacatctttcctgtatgtgcataaccatgttattttgctttcttatgaaaatgagattatgcatactgttcgataatctgtttcagattaaatatatatatatggtggaaacaaataatctctccctctcttttccttttcccttctctctccctcccctctctcctcttcttctctccctcctactctacacctatatccgggtatccctcccttctaccacaaaaat

SEQ ID NO: 107868 - DNA, 2154 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatcatttg

SEQ ID NO: 107869 - DNA, 2127 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgttgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatcatttg

SEQ ID NO: 107870 - DNA, 2208 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagatggcaccctgcattgtacatttgctttctatactacagcaagggaaacagctgcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatcatttg

SEQ ID NO: 107871 - DNA, 2059 bp, Homo sapiens
agaggtcttttttaaaaaaagatataagatgataaaataatctattcatccacagttttcttaacatgcatcacaatatttcatccttcctttgccttcactgtcttctttttcccaactcctgcaaccaccagtccctcacatggattattgagagcagacagtggctaaactgattagtgatatacttagttagacagtgacattaataataaatgacctaattttagatatacctagtaagattttcccttttaacaacttatttgtctaagcaaactcacagttatagcttccgttactgacaaaatgtttaaatgtatacactacaagcaaatgtttttcaagtgtggagcagtgtaactgtgaacaagatgcaaagcttacggcagaagacttaggaaaagacaaagtagttaaattgcgactaataagctatgtttcagttcacccgctggagactgctaatattctgtgtaagatggtagcaaattttaaaatcccagttgtcttcatttgctataaaaaccaatagaaaaaataataataatctctccaaagctgattgaacagatttttttaatgatttgaatgcggctgtttctcttttgtgttcttctccctccagaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggtacttatgttgtgatcatttg

SEQ ID NO: 107872 - DNA, 2069 bp, Homo sapiens
gtttgagcagcattgttagagcctgtggaaaacactttacaactgtgtaactgtcttcatctttacagaggaatagtctacaaaggaagacttgtaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggttttcagtgtttatgaaaattatattatgtatagggaatctctttgataactatatagaaatggacactaacttttgtatttaactataattctgccggtgaacacaggattttaactgatttaaataaggtatcagttggccgggaatttaggaaaaaaaaaaaggggggaataaagggggggagagtggaggcaggcgagagtacgtacaacgaaaggagaaagaaaaaag

SEQ ID NO: 107873 - DNA, 1443 bp, Homo sapiens
  misc_feature (1408)..(1408): n is a, c, g, or t
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcaggtggtgtgactcaggtggtgtgactcaggtggtgtgactnaggtggtgtgactcaggtggggtgccgagctcgaa

SEQ ID NO: 107874 - DNA, 716 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtagacattgcttctgcagaaagcagcatttaaatgctgatgcgtgacatagcttcctcattttatttttctgaagtgatctgctggaattccaaacagaagttccatatatacaaatatgtggcttaaatatttctaaatagaagaactattttcaagtaaaataaaggctgaggttttgtattt

SEQ ID NO: 107875 - DNA, 655 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtgagatgcttttgacaagttataataagggagagatggtagtaaaggaagtgaagaagcgacgtgaaattgaaggaaaagaaaatgacctgccttcttaccgcggttggaatacacacccaaacgagaggtagcagagaagcaagcagtgcattctgttaaaaattattgtgtcctcatttgagagaggagggatcctcaaataatacaactatgtgcaaagcaggaagtgaaatccttctcagtcctctccccagttgtaatccaagccttccacatctttcctgtatgtgcataaccatgttattttgctttcttatgaaaatgagattatgcatactgttcgataatctgtttcagattaaatatatatatatggtggaaacaaataatctctccctctcttttccttttcccttctctctccctcccctctctcctcttcttctctccctcctactctacacctatatccgggtatccctcccttctaccacaaaaat

SEQ ID NO: 107876 - DNA, 1043 bp, Homo sapiens
gagggacgcgctgacagtaggggcgccgcagggagagaagccgaggagcagcggagacaaccaatttgcagtttggggagggattttgtgcgggagaaaccacgcgagtccttcccccggagcggactccttgtgggttggtttccgggcccgcgatgtcagcatagcatcgtcggcctctgccccaacggcttcaagggagggactcgtcccggctgctttgcccgggaaatgggggtggaagggcctgcggtgtcgaggtgagcagtggaccctccaggaacattcccgacttcccttcgggagagagactgcctcctagaatcaagtagtatcgtggttactctttcgaaaacttaattggttctttctgttgttttcccaaggtggttgcacaattcccctctgccttcctgtggggtgtcatcatagcctggtcaatgagaagttgggtaacttcccagagggtcacggagggagtgggtggccaaggcaggaagaacagaagccaaccccgcccacagtgggaacccaggcgttaggagatgcttttgacaagttataataagggagagatggtagtaaaggaagtgaagaagcgacgtgaaattgaaggaaaagaaaatgacctgccttcttaccgcggttggaatacacacccaaacgagaggtagcagagaagcaagcagtgcattctgttaaaaattattgtgtcctcatttgagagaggagggatcctcaaataatacaactatgtgcaaagcaggaagtgaaatccttctcagtcctctccccagttgtaatccaagccttccacatctttcctgtatgtgcataaccatgttattttgctttcttatgaaaatgagattatgcatactgttcgataatctgtttcagattaaatatatatatatggtggaaacaaataatctctccctctcttttccttttcccttctctctccctcccctctctcctcttcttctctccctcctactctacacctatatccgggtatccctcccttctaccacaaaaat

SEQ ID NO: 107877 - DNA, 487 bp, Homo sapiens
gtttgagcagcattgttagagcctgtggaaaacactttacaactgtgtaactgtcttcatctttacagaggaatagtctacaaaggaagacttgtaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagaatgtttttgattcaatggagataccatactgatttctcgtgaagaaacacctgaatcctaggttacaacgaactagaaaaatgactgagagatctggcttcggtgataaccagagcttttgttcataaacatgtgctacatgctctgtgtcttagtccatttgcactctataacaaaataccttatacaaggtaatttgtaaataatagaaatttatttctcacagttt

SEQ ID NO: 107878 - DNA, 153 bp, Homo sapiens
tgtcaaagtaactattacctaaagaattttctaaaactcctaccttaaaatgtattctctttatggttttgagtttgtattattttttgctttttcaggtggtaccaaaaataagggttttctgctaatgtccaagaggtttttgtcttgcag

SEQ ID NO: 107879 - DNA, 407 bp, Homo sapiens
gtaaagtggtgtttatctcacctcacaggagatgcttttgacaagttataataagggagagatggtagtaaaggaagtgaagaagcgacgtgaaattgaaggaaaagaaaatgacctgccttcttaccgcggttggaatacacacccaaacgagaggtagcagagaagcaagcagtgcattctgttaaaaattattgtgtcctcatttgagagaggagggatcctcaaataatacaactatgtgcaaagcaggaagtgaaatccttctcagtcctctccccagttgtaatccaagccttccacatctttcctgtatgtgcataaccatgttattttgctttcttatgaaaatgagattatgcatactgttcgataatctgtttcagattaaatatatatatatggtg

SEQ ID NO: 107880 - DNA, 445 bp, Homo sapiens
tgtgagtaagaaactttgtgaattggtgtgtccgaatccgtcaagcacgacgtcggagaatttgtatgcgtgagcgagagggacgcgctgacagtaggggcgccgcagggagagaagccgaggagcagcggagacaaccaatttgcagtttggggagggattttgtgcgggagaaaccacgcgagtccttcccccggagcggactccttgtgggttggtttccgggcccgcgatgtcagcatagcatcgtcggcctctgccccaacggcttcaagggagggactcgtcccggctgctttgcccgggaaatgggggtggaagggcctgcggtgtcgaggtgagcagtggaccctccaggaacattcccgacttcccttcgggagagagactgcctcctagaatcaagtagtatcgtggttactctttcgaaaacttaattggttct

SEQ ID NO: 107881 - DNA, 420 bp, Homo sapiens
atggataaaaacattggcgagcaactcaataaagcgtatgaagccttccggcaggcatgcatggatagagattctgcagtaaaagaattacagcaaaaggtgtgtggttctggttttgaaagttattctttatcttggtacatggaattttagagccttttgcatctgaaaaatgttatattgttagaaattgccctgaagaactataattacagaaatgcaggtatatattaatggattaaatttgaagtttttgtttgttgttttttttaaaaatattgcaacccataggaagagttgatttgatgggctccttttcaggtgattgtgaaagattgtgaatgttgtcttccataaataattttaaaatatcagtatttataaataaggaggaaataactataaaaacagttttatgac

SEQ ID NO: 107882 - DNA, 316 bp, Homo sapiens
ctctattatatgtcttgcttgttcttttactagtctgtgcattcatgtttcagtagatggcaccctgcattgtacatttgctttctatactacagcaagggaaacagctggtatgtgattacaacttgatggaaaagtattcagcttaaaaaattcaggagaattagtgttgagttgtcacaagacatggggcataaggttagataattgatattttggcagaaaaagcaaagaaattagtttgttttgaagaccatgttacagtttaggatggaaagaatatttcttaaaatgagttttttaaaaaaaacctttt

SEQ ID NO: 107883 - DNA, 1559 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcaggtaactgttttgcattaacaaatatattattatgtgtgaacacacattttgccatacatgcacagatatgcatctcttttacgttatcaaacatcctttttaaactactgacagccaaagttaaggctttcaaaaaaacaagtcccataataaatgacatgaaattagaaaagctgaatatggtaaaactttattggaaagtaccttagaatttatgtcagatttaaaaatacatgttaagccttatccatatct

SEQ ID NO: 107884 - DNA, 971 bp, Homo sapiens
gccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtagacattgcttctgcagaaagcagcatttaaatgctgatgcgtgacatagcttcctcattttatttttctgaagtgatctgctggaattccaaacagaagttccatatatacaaatatgtggcttaaatatttctaaatagaagaactattttcaagtaaaataaaggctgaggttttgtatttcctactgaccgtttttctacatcacaagcatttcaacaaagaaaacatttaacaaagaaatagggctggacacagtgactcactcctgtaattcaaacactttgggaggccaaggagggaggatcacttgagctcagcagtttgagaccagcctgggcaacatagggggatccctatctctataaaaaatgaaaaaattagccacgcagaatggcacacgcctgcagtcccagttactcagtaggaggattgttt

SEQ ID NO: 107885 - DNA, 624 bp, Homo sapiens
gtgagttctgtcctccagactccatgcccatccttcccactgaaataaacatcccaaactaccccttctcttggtatttcatgaaccactgccactgacccaaaaaggtatctttgctgtcctttgtacagaaactatttgggatctgcattaatggtgcagttgtcaaatcccagtccaggatctgccctttaccatttttgcaagcctgaaagtcgctttaaaggcatatgtttttcccctacttgcttcactggagaatcattcacagaggatctgtcattgcagctcagcatagcatatacctgaaggaggcaaatgtgatttcttaaaatcacgatttcggatttcatgtcctccacgtcccattgttctctaatgaagtcgtgccaataccaaaatttcttcttactgtgttgcagctcacccacacatcatcacacgggcaagccactacaaaactttcaccttcagtgcttgaatcgtttcataactcgccttgttatctggtgaagggcgaagccaaactcacagaacttaaagtcgatgctatttctaaagtgtgtggcattgttcctcagcagccctggcttctagctttccattcctaaacttgctgctcag

SEQ ID NO: 107886 - DNA, 210 bp, Homo sapiens
agtaagcatctctatcaaaatcaaggatttgcgaataaaatttcccactcaaattatgtaagttccaagtactgctattatattttaaaagatttaagccacaccaacttatacattagcattgcaagggccatggttcttgtttaaaacaagacacttaactgaaagaagccaaaagacagtaggtcactagagccatggcctttctgt

SEQ ID NO: 107887 - DNA, 232 bp, Homo sapiens
ctcccgcctcagcctcccaaagtgcgggaattacaggtgtgagccactgtacctggctgttaatctcatttttaaaacagaaaacctcaggctcagaggctttgattgggcaatagtgtctggccagatttaatacatttttactttcgttatttttcttttctttcttttttttttgggaaggggggccgggcagggggggcacccccgagaggcgcaccgggcgggatcc

SEQ ID NO: 107888 - DNA, 477 bp, Homo sapiens
tcactggcaatttagacttgtaagaaaactcttttatttgtttaaaagcattagtttccttttcccagcagttttgtgctgtactgaaacaacgtgttcctggtgtgcagtgctcttagatagtagtgtgtctgtgttgcctttcaacaaagaaaaaactaccaagcactgtctgctttaaacatcatccagagtgatggtttgcagcaaagatgtccactagccacagtgaattttttttctggataatagattcatacaattccatgtcaaagcaaagaaaaaaaagtgccacattttagactgtgaagtcttattataagtaagctcagtatttccattagttactcattaggctatttaataaggattcttaacctggagtaagggtctgtggttaggattcaaggagttgtcagtgaacttggaagggaaaaaactgcatctttattttctctaacctctaactgaaatagc

SEQ ID NO: 107889 - DNA, 356 bp, Homo sapiens
  misc_feature (350)..(350): n is a, c, g, or t
tatctattataagtctactcaaactttttgtggaatgaaatggagcattaaaaaactaagttatgtctcaattttaaaagccaaatccacccttccacaaatacacaatattaacgtcaattgcttcagactttttacaccctttccatcagacaacccacaatctaggaggggctcggttgtgcacatagtacaaccgtccttaaccgcttagttgactaaaaactgtaataaaagtaaagagctgttttgggcatcaaaggacattaccaaaaaagtgaaaaggcaaccaaaaagaaaggaagtcgaagtatctctgtttgcagacgatatgattctatatctagaanacccca

SEQ ID NO: 107890 - DNA, 788 bp, Homo sapiens
aaaggatgaatagaaatagtaacttcatgtagagattctttgcagactcactaattccatttcttctgttattttctcatgtaggaaatatattcagattgttaaatggaaaggtcctgatttttttaaccttaatatggaaatgaatttctgacttggggaaatgctgttaactttttaatttatttggccttttccatataaattcccatgaatccttcatatttctgtttagtctcttgtggaaatatattatttatattgaacaatgagttgacactctactgcaactcttcctccaaatcacttaattttaaaaaataaggtagaaggaaaagacgtatttacttgaaatatcagctttttaagctaagcgttttcttttctcctgcatttttttttctttgctacatttcttaaagcaaaatgagaaaaaataaaataaaacaccacagggaaggtttattacattatctggcatacaatttgctttttgaaccagtcatgaaaacttaaatcaaaattataaaaatcaaaatgtctaatcctgtctctgaagagaccccaggaaccatttagagtaacagacctgaagaaaagaaagaattgctgaatactccattatgaattagagcattccattgtcctatagagcaaatgaatccacagagtaaaatgttctcttagtattcatatcaacatttcactagggaaaagttggactggaaaattctaatcaactataaattaaaggtggatgcatgatgaggtgaataatttaaggttat

SEQ ID NO: 107891 - DNA, 731 bp, Homo sapiens
aatgcaattacaaagtgttatataaacaaatttagaacaatataaaccttgtgttggtgttttggatttttcagaaaggatatatgtggataaagcctgttgtccaaaatttgagatgacccatgctctttatgcctgaaccatcctttttttcctttctcattgctgctgactcactcctttaggtatattgtctactctcctcagcaaacctatttccaatcatgtacctcttctagtgaattaaaatcatattgtgattgagaatgaaagacttttttccttatactgactgtctgttggaataattgtactgctcgctctctgtaatgttctttatggtttgtattatgctaatacatttataaaagactatctaaacataaggctgccattatcgtgaaattaatccaccttgggtgagattgtgaagaaatacatatatgtgtgtgtgtgtgtgtgtgtgtgtgtgtgtgtgtatatgtatatatatatacatatatatatgttctcttgtttttttcttgcgactgggtctcgctctgctgcccaggctggagtgcaatggcaggatcacagctttctgcagcctcgaacttctgagctcaagggatcctcctgcctcacccttccaaagtgttgggattactggcatgagccaccacacccagctttcctttataatctgttgtatactttctagttaaaaggttaaagtgggttttagaaat

SEQ ID NO: 107892 - DNA, 567 bp, Homo sapiens
ctggagtggaagaataaaaagtggtataaaaacaggaatgaaaatgaagaagaaaaatgcaagggtctggtgaaagcagccaaatctatgaacaaatggagaactcagagaaagggtcttgccaccagggtgggaaagagtttgggaagattagcacatgagaacctctcggtaatcaaagtctctaaatatgacaaattgaattgagactcctttcatattctttgagaagctaaataaatattgaagtatattttaaattagcatttggaaactaaactgggtttcccacaaagagactaagccatgtgggtcctaggttttatttaggttacatgtatctgttgcctccctttctactccacacatatttcttcagtacctaacacagtgcctgaatgattcaataagtgaatgtatgagtggcacatatgtataaataagttgtatctggttccttctgagaaaattcccaggtttcaaaatcagtattaaccaacatttccaggtgatgtcactttgctgaatatttaagcactaatggtccttgaagccaggccagcagat

SEQ ID NO: 107893 - DNA, 670 bp, Homo sapiens
gacagaaaaagctaaagggatggggtaatagaaaagcgtttatagttgatattatacttccgagttggttctaattcaagttaacattcctcatagtcattatgtagctcataaattcaataaagtgttttactgttactataaaaatgacaggaggggggttttatgttgtaagtttcgttagttgctcttcctgttttatattgaagttctcaggccattatgtcattaaactccttggagtctgaagggctcaagccttccatttcttctcttttgcagacttggccaaggcaaatgttagcccaggccaggtcaggtcactagacacttggagccaactggctatgatgccaggggacagggctgtttaaatctattatttcatgagaagtgccttcaacccatgcagatgtaatcgtgaggagtggaaaggtctggggtgggagggaagctttaggcagactaagagttctaacaattcaccctagaaagaaacagtccgtttggtcaggaggcagaggagggcttgctggatggggtcaggaggcagaggagggcttgctggatggggtcaggaggcagaggagggcttgctggatggggtcaggaggcagaggagggcttgctggatggggtcaggaggcagaggagggcttgctggatgggg

SEQ ID NO: 107894 - DNA, 550 bp, Homo sapiens
tctaacgtcagaacggctgacgagcagttgattgtccttgcttgtgttgttgacaggggtgggtggggtgggagcaggggtatggatattgcataagttattgaaatgctgacccccgttcaggaaaccatgcagccccttcccttcccttcccttcccttcctttcccttccctagccagggctcaggtacctcactctcctgccttgtgcgtagctcctggggccccggtcagtccccagcagccttggcacacagtgtctggagcctctgctcctgctgcaaaagcagaaaccatgtgaaccttctggccagtactggaaaggggaatgctatttatttttatattgtgtatattttgtcgtggtctgctgattccctgtttcactgagagcgacacttacctcaatagttagttcaatattgtgtgttggataattttttaaaagaactttttaaaaagctttttgatccttggaggtctgtagatttatttccatatgaactggttattttgtataaagtacatgcttaaaatagcaaggctcct

SEQ ID NO: 107895 - DNA, 600 bp, Homo sapiens
gtctggcctccacacgtttctcttgtggaggccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcataaaaaaaaaaaaaaaaaaaaaaaaaaaacaaaaaagaacaagaaaaaaacaaaaaaaaacacaaaacgaaagaaaaaacaacaacaaagaggggggcgggcctccctaaaaacaccccaggggggggcacaaaaatgcgcgaccacgaattttgtaagagagggggctcca

SEQ ID NO: 107896 - DNA, 1609 bp, Homo sapiens
gaaatatatcattaataagtgtagagatggtaaagaaagagtaaaaaatgatccccaagaattcagagaccaaaagctggggaccctgaaaaaataccgtagcattatgcccaaacctatcatggtcatacccactttggcctccctggcttctccaactacactacagtcccagatgcttgggggcctaggacaggatgttttgttaaataattcactcactcctaaatatcttggctgtaagcaagacaacagctcttcccctaagcccagctccgtgttcagaaatggattctctggcattaagaagccttggcacagatgtcacgtctgcaaccaccacttccagttcaaacagcaccttcgagaccacatgaatacacacaccaacagacgcccttacagttgtcggatttgtcgcaagtcctatgtacgtcctggcagcctgagcacacacatgaaacttcatcatggtgagaaccgtctgaagaaactcatgtgttgtgagttttgtgcaaaagtgtttggccacatccgagtctattttggccatctgaaagaagtgcatagggttgtgatcagcactgagcctgcgcccagtgaactgcagccaggagacataccaaagaacagagacatgagtgtgcgaggcatggagggatcattggagagggaaaacaagtccaacctggaagaagacttccttctaaaccaggcagacgaagtcaaattacaaatcaaatgtggtcgttgtcagattactgctcagtcttttgcggaaataaaatttcatttacttgatgttcatggagaggaaattgagggcaggctacaagaagggaccttcccaggaagcaaggggactcaggaagagttggtgcagcacgctagccccgactggaaaaggcatcctgagagagggaagccggagaaggttcattcctcctccgaggaatcacatgcatgtccaagactgaaaaggcagctccaccttcatcagaatggcgtggaaatgctcatggaaaatgaaggaccccagtcaggaaccaacaagccaagggaaacctgccagggccctgagtgtcctggcctccacacgtttctcttgtggtcccattcaggctttaactgcctgctttgtgcagagatgctgggacggaaagaggacctcctccaccactggaagcaccagcataactgtgaggacccttccaaactgtgggctattttaaatacggtctccaaccagggagtgatcgaactttccagtgaagctgagaaatgagaccccaaggcagcctggggttaaggagagagctctgccgccaccttccttcagagcttcgtgctttatggtggtgcttagtcacaaagatcaaacaacaggattggtgtgagtgaacagaaatgatttttgtacatggttttattttcttaacgaaataaaatataagctctcgaagcatatttttctaactatatgcagtcttattttaaaatacgtactgattcttaatatcttagactttcagaataaataaaaagatcaaaatttgaagattgaaatttagcagaatataggctgttcttcaaatacagctctcagtga

SEQ ID NO: 107897 - DNA, 541 bp, Homo sapiens
ggtggggtatctaaggatcccggaatctgaccgatgcctctctgagttcctccgtctccaactgcctgcctgacccaccttgtggtcctcacttggagcatgcagtgctggaatcttcttagtttcagtcttactttgccccccgaggtatgttttctctgcagcttccctttccaaggacatcctagagatggatgatggaacttcccattgtccttaaaccctttgggtactggaaagcctgacctgggactgggtacttcagcataaataacacaggggagaccagatggatggaggaactgcctatccctgtcccattgtcttgtccacaggtcagcctcacaaagggaaagagcccttgaagggaatacagtagaagctcattctcttagtgacctggggacattggctcgagatgaagcctggcaggagtggcaactccaggtgatttctgcacctttcctatttcctgggaggtgggccaggccacagtgttagcgggaaaggaactgaacagccagactagtcagagggagtg

SEQ ID NO: 107898 - DNA, 924 bp, Homo sapiens
acatttttaaagtttcctccttggcctttgcacctctcatctttgttatttgttcattattgcctattggggtgatgcctattattttctctctttttacattccaaagatatttcctttactgtagaacaggggcatccaagggagaatctcaccacgaccccaggtctagagcgcccggagtccgccatccctgggaatggaggcggcttcggcctggggtcgtggtgagattcgttggtggctgcgcgattgtggcggagttgcaagcaaacgggtttcatcaccttaaatggttttgaaccaaagaagctgtattcccttaaaaagacggacaacccatcgtgtgaactatagagtttgtgaacaaatttatattgggttcatagtggcgtcatgcacgcagactcctgcgagttcccctaagttcttagaggactgctttgccttttgatctgagagttgcaaagttccctaaagaatggcccttgtggataagcgctaagtcaagagacagcgattggacagaatttgtgaggaattcgtccccagatcatgaaagtcaccctgaaccccgcctcgtggtggctctgctggatggacgggactgcactgtggacatgcccatcctgaaggacctggccacctggccttctgtgaggctcagtccatgcaggagatccacgagaaagttctaaacgaagtcgtgggcgccatgatgtaccacaccttctccctcaccagggaggacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaa

SEQ ID NO: 107899 - DNA, 283 bp, Homo sapiens
agagagaaaatgagtcatccgtgggtactaaggggctcaaaagtggacccaaattaggcctgatctgccttcctgaatgaagcccattgtacattctgggtcccctcctccctttaaaatttctcaggtctttaccagaaagatagctgcatcctttgtaataaaactgaaataacatgaaacaaagttatcaatccttagcctctctcagccaagactgaggtataataaaaacagatgtccaaagcctaatgctgtacaggatgctttgcacatccactct

SEQ ID NO: 107900 - DNA, 186 bp, Homo sapiens
gtcgcaaattcctgacctcaagcaatccacctgcctcggccctacaaagtgctgggattacaagcatgagccactgtgcctggcccatatttattttttattctttattttgtatacaagttcttggtcagatacaataatacctggtcagatgagataatgagttggaaaatgctttgcaaatgg

SEQ ID NO: 107901 - DNA, 544 bp, Homo sapiens
ctggagcaatggccttaagagttgggtggctctggcctaatctttggtctgggaggtgaccagctacctccctgctgctcctgggatccacatcactatctggggcatctgggaagtctaactgtagagcttgggatattcacaagatggcaggcctcctttctaggtccttgcctctcttgaaggaagtgggcagtattcctggtgggtgtacctagagcacctctcatagtttttttgattctgattaccctaagatgtgatgtaagtaaaatctggtaaatacagtttaaatccatttcttgtgtacaatgctgtatgctaggtgcaaggctctggagttaaaaagatgacataatctactgtaagggcagcctgaagggtttctctgggtttctgtatgatgcacgttagtggaaggagagggcaatggagagagagggcattcatgggctaattaatcatatgcatgttagctgccaatcattttaccactatgttcttggagtccctccttttcttcagatataagtcttccaacaca

SEQ ID NO: 107902 - DNA, 811 bp, Homo sapiens
ttattcttttttatttttattttttttttgaggcagagtcttgctctgtcacccaggctgcagtgcagtgctgccgtcttagcttactgcaacctctgcctctccggttccagcgattttcctgcctcagcctcctgagtagctgggattacaggcaccagccaccacacccagggagtttcaccaggttagccgggctggtctcgaactcctgacctcaggtgatccgccagcctctgcctaccaaagtgctgggattacaggcgtgagccaccgcgcccggccggtttctgctttgatcggaattaagtgggcagaaaagtctaggcgggctaagtcttgcctatgcatctgcgcccagctgctcagactggccaaacagacccagtcgtttagtctaacgcttctggaactccactgaagcgttttgcattgtttcgtttggagccttcaaatccgagtgtgtggcaggagataataatcctagcagaagctgtttactgctgacgcgcctcccacttcccagatactgacaccggctcggggcggatccagccttttccgctcttccctccctccaccccctcctttccctacaactactctcaaaggaaaagggttggatgtcccatttgggtgaaaacaaagtggcataaaagcaaatgatcacctttgatagccacatattagaattttccgagggtatttttaaattacaacgattctaatgggcagctgggctgagaatcatcagatttgaaggtctggtttcacatggctcttgagctgagaagaccggattttccccccc

SEQ ID NO: 107903 - DNA, 718 bp, Homo sapiens
cacataaatggacctagaaaaaccatttaacttattcaacatcaagaaaatatatgaatcaaatgagtttttaaaatagcaacagtaatcataccaagtaaaattacagtaatctacaatttctgctattatttaacatttttttctgacagcttaagcaaatgccaaaatataagaaacagaaaaaaaagatggaaggaaagaaaagcattacctttattcaaatagagtaatagtggacactctgcatataaaatattaatagatcagaaaacctaataaaacaaaaaataatgttcagcatggtcgttggctaaaaacaaaacttaagtgcttatataaaaaaacaccaattagaatgtacaatggaattaaaattccattcataagtcattaaaaagaaaataaataggaatagatttcataagaaatatgcaagagccatatgaaaccatattctaaaaattactaaaagacacaaaaatgccttaatttaacaaaatgatatagtcccagagagcaagcacactattttaaaggtttccatactcacaactctatatatttaataacaatccatttcaaaatctccttagtgggtttccaggaaccaatgagttgattataaaattcttcttgaaaaacaaatatgtgaattgagctaagatagcagaatgatggctggagccttccttcttccttctcagatgtcaaacat

SEQ ID NO: 107904 - DNA, 380 bp, Homo sapiens
gatgtagggaaattggaaccctcacacattgccagtgggaatgtaaaatggtttagctactgtggaaagcagtttggcaggtcctcaaaaagctaaacaaaattaccataagacccagcattccattcttggtatatacccgaaaaagtgaaaacaggttctcaaataaatccttggacacaaatattcacagcaacatattcataataactaaaaggtggaaacaacccaaatatccatcgatggataaatggataaacaaactgatatatagacatggaaaggaatattcttctgacatggaaaggaatattcttctgctatgaaaaggaaagaagtactgatatatgctacatgtgggtaaaccttgaaaacatttt

SEQ ID NO: 107905 - DNA, 298 bp, Homo sapiens
acacagagggtgtgcacagctggcactcccccatgggcccacgctccccttccatgccacaggtctatgggatgaggagtcaagctagacacagagcagggagggggcatttaggggacttactcggaaacatcagatactttcacgtgctgagaaagctggtatttcgggaactgcattggttgctaaatcactgccatggtcaggtgtttctccaacatctatgtcaacaacccacaatatggatttcacattttatatcatgacgcaggccatgtacacatcttccctgaaacag

SEQ ID NO: 107906 - DNA, 408 bp, Homo sapiens
ccaccatcccccctacggacactcatagccacccaccaggtacaaagtgcttcacagccctcaggtcatggatgagaaaacggaggggtggcagggggaagcctcctggccatgatcacacagctggaaactggtggcatctgagttcacacccaagatcctggctgagtttgcacccttcctccctgcccctcaggaaccaaggctggccatctcgtctctctgggcccctggacttcccgtctgtgggcctgcttgtgtgcgtgcatccctggggggtggggagctccagctgactcagcaccctgcttcctctgtccatgtgggcagaaagggccaaggcaggcccagagcctgtcctccctctgtctgcctcttcaggccagcctccttggtgggctcccccat

SEQ ID NO: 107907 - DNA, 229 bp, Homo sapiens
gggcagaagccattgctggtcacggtcactgctccatgcccagtgcctagcaccgagaagtcctttgatatccatttgtgggcatgacgctcaccctgtccctgagagctggacccaaggaaggagcaggaccccctctactttacagcccatgccacagttaagctgcggctactttgcatctgccctgtgtgatcttgagtgagtcatcgaccctctgagcatctgg

SEQ ID NO: 107908 - DNA, 480 bp, Homo sapiens
cagatgggagataagtcaggtcaatttgatttgatcaacacccctgattgcatttatttccttatttctaggctggctccagagatgctatccccaaatgggcctctggaggacaaatcttttggtgaacattcattaagcaaaataatgcacttatgagtaaagcacatggtgacttggatggtgtgccattacctccccaggacagagtccaaactgcttgccatgataggtgcatgtggtctggatcctgcctttccccacttcttcccacctggccctttgttcctggtatcctttctgcctggcactccttttccttcccttctttctgtttggaaaattggcctcccttaagtcttgtctgcttgtaacaatctctgctttaacccccatgacactctcatctcccctagttcttgaggtaccccaggcttagaggacccacagaccctggaatccatattacagcatttgttt

SEQ ID NO: 107909 - DNA, 341 bp, Homo sapiens
gaggtatatctgagctgggccatgcaggggaggcaggatttctccaggtggagctcggaagggtttgaacaagaatgaaagttagagacgttgagagcctgatgatgggatggtgggtgggggagtagaaaaggctatggaaggctcttgcccgccaggccaagggcatgtatcctgtgggcagtgaggagccactgaaaatacaaagtgcatgctggcagggtgtgggggtcatactagaggtgtgctgtaggaagggagccatggagaaagtggggatgtggtagagtaggagcatccttaggggaaccaagtccaggaaaaatccctctccacttcct

SEQ ID NO: 107910 - DNA, 253 bp, Homo sapiens
acccaagaccctcacagttttacagatggggaaattgaggctcagaaaagttaactaccttagcgagaaactcctggcagggatgggacttgcacctgattttcctgactgcccatccaccataccatgcctggccctggggagcaggtcacagagtccagaaacaagtccattcttcttttcttggcccagtggcccttgttttgtattcagctttctcctccatcctcccatcctggtttgatttatcctg

SEQ ID NO: 107911 - DNA, 212 bp, Homo sapiens
aatgatggcttggctgagaacttaatgcaggagatggtaagtattactgacctggtcttgaaaacaataaattctaaacaaagggcaaatagagataataagtgaactcaaaatgagtccgaatatccttaacaaagaccgaaagaatacaaaattcaaaatgagtagtttgcagaatacctgcatgccatttctcccctgaaagactgatt

SEQ ID NO: 107912 - DNA, 401 bp, Homo sapiens
tgggccccagaagtgaattattacaaggaccattttttgcctgctccatttgagatgctgccatcataagattcaagtcttaactcttagcattaggatcccaagtgaactttctctgaatttcacaatgaatctctcttatttttaattgtaaatgactactataggtagagctcgagatcctctctaattcaggagatttgccctgcacgtgggattttgctcacaagaagggcaatttctgtttgagaatcacactgtgaggctgccattttccctgcacacattcttcctatgttctgttgatctacactggatgttagtcggctccaaagagagagaacagttgagttcctcacacgttctctcctgctaccttatgcagcactggaatcaaagga

SEQ ID NO: 107913 - DNA, 586 bp, Homo sapiens
atttgttgaatgaatgaaatgttgttcatgatttcttgcccatactcagcattcataaggaatattttgtacttaacgtattttttcttccctatagtcagattgatattctatttgttgctttcgtggctgtctcctgcagttctgcttctcttcctaatttgactctggactagaaaatcagataaccaatgtgatagatgacatagatgtctctgtaataagagatatttaaaaaaatctgtaagagagaaggcctctcttaaaagcaacaagaggatggccaggcatgatggctcatgcctgttaattccaataatttgagaggctgatgcaggaggatcaccagcagttcaaatccagcttgggcaacataggaagactccatgtctacaaaaattaaaaaagtgagccagatgtgttgatgcatgtggtctcagctgcttgggacgctgaggtgggaggattgcttggtcccaggaggtcagggctgcagtgagccgtgaccatgccactgcactccagcctaggtgacagagcaagatcctgtctcaaaaaaaaaaaaataaaataaaaaataaaaaaa

SEQ ID NO: 107914 - DNA, 354 bp, Homo sapiens
ctgatatattctggagtttcctccccacccccgcctttttcttttctctctttctccccttgttgaaagatactaacttctacagtgttggtgtgagtagagtatcaggatattgatcttaggggaggtgaactaattatagatttgttttttcattttatgagaggctattcttcataataggaatatagaatatatgccatatacttgaggttacttttgttaatccctttaagaatggagcactttaccttgcttaacaagaaggaaataattgattcagatgctgcatgctgtgcaaggtgagttttgaatgcagtgaggcgtatatgcagtggtctgacttccgtaagc

SEQ ID NO: 107915 - DNA, 463 bp, Homo sapiens
cgcgcccctgcactccagcctgggtaacagagccagaccctatctcaaaaaaaacttccaaaaacaatacagcaacacatacagatgtaccacggttcgcgtatggagcctcctgttggtggagactgacgtcgttttcaaatgcttttgctatgacagaatcatgtgaatgtttttcatgtttggtttttttctttgagaaaatgataaaattatctcaaaaatatcattaaaaaatttaaaaaagtagagacgggggtttcaccttgttggccagtttggtctcgaactcctggcctcaagtgatccacccaccttggcctcgcaacgtgctgggaatacaggcgtgagccaccgcacccggcccctgccgggaattaaacgcaaaccacttacagactacagttaatgtcgctgacacttctgctcccaggggtccccatgaggctccagtccccagggc

SEQ ID NO: 107916 - DNA, 431 bp, Homo sapiens
catggccctatagcccttgctatctacttgtgataacaagataaatacacgaaaagttaaatagtacaaggtagtatgtgatcaagggacatgggcaaaagtgttacacaattttagaaattagagagctgactacctggataatactggaaacaaacgagaagggcaccaaaaccctaaaggtcatacacaaactaaagctaaaatatgccaatgattatgtcagttgcctgctcaaaaaccttcaaagacccatcactaataatcaaagaaagtccaaactccttagcttggcatgcaagaccctacaggccctgaccccttcctacctgaccaggctttactccagccacactgctccattaatgtcccttgaacacactgacaccagctgctgtccgccctgctttgctcctgatgccctatctcag

SEQ ID NO: 107917 - DNA, 288 bp, Homo sapiens
aatgcattgaacaaaatatatcaagtactatttgtgtacattgaagttatggttctttcctgcttcataaacattcatgggggttggtcatgaaacactggatgaaattgggtcacaaattgccatcaggaagagttggctgctgcataaccccctctgtccacttgtggagaaactgaccctgttaaccgtcgggcttgctgaaggtgccttgcaggtggctgtgctcagttttcatgctttgtgttttgcttaggacacgctgcatacttaaatcttcttcatcct

SEQ ID NO: 107918 - DNA, 197 bp, Homo sapiens
cttcccttccctactcttaatcatatagcattttcatagagctgtgtaagttggcccttgtattggtttttcagtgatgaggattttttttcatttctttaaattttttgagagggaaactggttagattaagcagcattttaaattatatgtattatattttgtgtatttttacatattatgttttctaaagttat

SEQ ID NO: 107919 - DNA, 674 bp, Homo sapiens
ggttcagctttgaggttgattttctttatttcatccttgagttgggagtttcagtgatgtgaaagaaaaagatggggacaaatctaacacaatgaaaataatgtttccttttcaaagctttatttacaacaaagtgaaaagaagataaatgttgtaaaatatagatactttacaattgtaatttctattaatttctcacctcagtgaagcttgggtgcccagaatgtgacaatcatgttgtcatatgtgaccttgccattgggaaaatgtttgtgggtcctcaaatttcttaaagggggatgcccttaaatcaggaaactttaacattaagaaatgactcactcatgtgaacttcttcagagggatgttgattttctttgaaagttgaaaccctggttgttgcagcatgtgaaacatttaatttatccaatgcctctgtgaatgcgtggatgaaatttcccggagggctccccgtacttatcatttttccctctcaagcacacacagccaaggaagtgggccagcagacaccctgaacttccgccaaaccgagctgctctgagcctccctctcctggcctgagaacaaaaaacaagccctcctccttgcctttcctttagaagtggaggtggggtgtaggggtgagaggtgctgcacgagtgtttaaaaggtgg

SEQ ID NO: 107920 - DNA, 674 bp, Homo sapiens
atatccacaaatcccctttacagtttattctagaacaatgcaagttaataatttagtactgaaatgaacacatgtgtctgtgtgcatgtacactgaattccacggtgtggtgcattcattacttctgcttctgtattcatttctgttctcaaagttaattcacttataaatatttgacaatcatttttcaatctgaattacagcaggcatatgaaaactcaaatacattaaaggtgttcacacttttcacatgtaagtacctacttgtcatcaaaactaaacttcttatttagtactggctctctaactgtaaacgaaaaatgtaagtcataaacttgctaattgtttttcctattacttgtcacagataaagacttgaatgccagttgattcccacattcttagtgttcaaactaattgcccacatctaactggaaaactagtaaagaacaatgagccaattataggaactttcctataggtcttagtaggaggaagaaaaggaaaggatgatcagctcttaaattttttttaaaggtttattccatttcagcatgaataatgggcagactcagtgtccatggggtatgggctctgtctgagttgtttttcctgtagctatgatgaatttttaaagtaataaattacctctgagtctattcagataaactgaa

SEQ ID NO: 107921 - DNA, 334 bp, Homo sapiens
ggagccaagcttcagctgctgcctttagagggagtgtgggatcgcagtttgccaatctctacctctccttgctgcttaccactggctagcctcagtcttctgtggaccctcctgactgtgtgtactggtggaagttttagttgtgtaagccctgaggtcatgcagctctgagttcaaatccattctccccactttactggctatgtaactttgagtgcatgactttctctatgtctcagtttctcttcctaaaagtagagtcacacacttccctttttgtgtgattgtgccagggtagcatttggcacctacctttagcgtacatcatcattat

SEQ ID NO: 107922 - DNA, 347 bp, Homo sapiens
ctgcctcatcttcccaaagtgctgggattactggcctaaattattgcttttattgtatgcattatatactattttatcataacaaaagttaatggttcaactatggcatttagagctgcccacgtagcctgattgtctatttagttcacttttgactgagtaaaatggagctgatctatctgctattaaagagagttatattctgaaattttacatgatgttcataatgcctggaactaaccagcctgaaatggaatcaccgttgtactgttttcaattggctaggtgacttattctccctatacttcagttttctcatttgaaaaatgtagataaaaataaataaa

SEQ ID NO: 107923 - DNA, 409 bp, Homo sapiens
tagaaaagttgttttacacagtaaatgaagtgccaatgcagacaaatgtaaccaacatgaagctggccaatagaattcaacaaactgctaaggtcattaatataatttgttttggcactgctacgtttcctagtgctactctgagtagtttgctgggcgcatcaatttgttttcagctattgtgaaatcggatatcttggctttcatccaaaacaccctctccatttgcatatctttgttatcatttcaggttctcagaacatactgtggactatcacaccatctgcaccaagatcctcacatccaaacacaaattaaaaatgaaactgtaaaatttgcaaggaaacaatacagaccttttatctcattctccctctgttcattttcaaaagagaaacttgcttgtagc

SEQ ID NO: 107924 - DNA, 327 bp, Homo sapiens
tgagcatctcctagtatgtgtgcttttgagcttgtccagagcaggggttcttgcttggttttgagccacagtcccctttggcagtctcatgaagcccgtggagccctcctcagattcaggctttcgcttccctagatcatgccaatctgtttgagaggtttcctaggtcccatcccagccagcactgggtaagggtcccacgtttgacttggcttgtcaggctggcactaaggttttaagtaactccagtgcccgagtgagatgggaggagcccaggaagcactttggggctccaagcaagtgtctccccatgagtcactgctgtgt

SEQ ID NO: 107925 - DNA, 370 bp, Homo sapiens
ctccaggacctcttttagaattatcttattcctaatttgccaggaggctgggtgtagggctagttactaacaatcttcctttcattcttatctggatttcaccactggcctttctgatttgtgtcacctgttagccaccgtctcaaccagccagatgctccccctgagcctcctctcctgccatgatctgtttctgacaacatcctactgaggcattcactaagacaacttaagagattgatttaggggaaattattatcaagttgtatgcagaggcattgtacctaattttctcttttaaaattagattcatcatgaatcatttgtatttatttatcttagagaaaaccttactaattcatatatagta

SEQ ID NO: 107926 - DNA, 374 bp, Homo sapiens
atgtggcttcctcaagaggggaagggagaagggcacaaacgggtgggtctggcacctttatagccactctctctgctagatggggaaactgaggctcagagaggtaagggccagctgggaactgggccactgggattcgattctaagatgagtgtgcttcctctggctgtgttccagatgttctcagctcctaaacaaggaactttcataaacatctgggggttcacaccaggtgtgtgcatgccctcaagcgtgtgacccacatgtgttatcataagaccatccagagctgaatcttcttgtaacttccaacaccctccatacagccagcactgggagcttgagccccagacagtgacatcattcctccaact

SEQ ID NO: 107927 - DNA, 493 bp, Homo sapiens
tctccaaaggttattggttgactgctatggaagattcaatgttaacagaaatgcaacattggtaagaaagtagcaaaagagtattgtaaataataagaaaataatgcagtaaaatggtttttgtaattatacacagatgagtttacattagtgattttgtttattaaaaacaaattaagcctaattttctttcctgagtgggcaaaaaaaaatttaaggcagtcatgctagctctggaagtgttagaattttttcttctgaccaggtcttgctctgtagcccagactggagagcaatgatgagtgaggtcgtagctcactacaacctttactcctgaactcaagtgatcctcccacctcagccacctgaagagctgagactacatgtggaccaccacacctgggtaatttaatatgatttttttttgaaagacagggtctcccaggttggccagtctagtttcaactaatggcctcaattggtcctcccacct

SEQ ID NO: 107928 - DNA, 223 bp, Homo sapiens
aaaaaatgagagcaagggcattctgtggtttggactggggtctcaaaatgcctctttctccttagctcaagtggcatcctttaccttcagctatctttagggaaaaaaaaacaaattttgacctaaaggggatgtttggttgaaaaagagacctcagtgctggtatagttgctaatttaatagtcctttttatttggctgctccttgttcttatattgtacat

SEQ ID NO: 107929 - DNA, 851 bp, Homo sapiens
ctctctttctttcttttcctctcctttcccctcttcccctctcctctcctctcctcttcttttctttttctttctttctctctctctctctctcttttttgttttcaagacggggtttctcactgtctcccaggctggagtacagtggctcgatcccagttcactgcagcctcattcactcaggctccagtgatcctcccacctcggcttctaagagatgggaagcaggaactgccaggtcagttaagggatatacctactacttgcccagtgtcactactgctatattcctgatctaagcagtcaagggcctatgtagatgaaatggggtacaaagataaaaatacaaagacagacataccactgtttgacgtgggagtgacaaggtcacactgcaaataaatgtaggctgaggggtatttttgtggccatttttggaaagtacaatctgccatagcagtaaacacaggggcaatgaacaaggggcttcactttgcagctcctctgctctgtttttattaccaaaaaaaaaaatccttttaaagtaagatgcctagacaacatagtgagatgcccacttcttttcttttctttctttctttctttttgagacggagtctctctgttgcccagggtagagtgcagtggcgcaatctcggctcactgccgcttccacctctcgagatcccatttctaatttaaataaaaagaaagaaagtttctttgtggatgaagagatagacgtgtacataactggttagactgtggggcatcatctaagaattataagccaagtgataagtgagtgcagtggagaaagatatttattttgtctttggggttgggtgaaa

SEQ ID NO: 107930 - DNA, 167 bp, Homo sapiens
ctccttaaaatctttcaacatgaatcacatggcttagcaggggtaaaatattttaggagcctcctcctagaggatctcactcaatcttactcccttgtagaacaggcgatatcttcaccatgcgcacaatgaaatcaatactcagagaaggcagataattctccacg

SEQ ID NO: 107931 - DNA, 648 bp, Homo sapiens
tgcctggagcactttccaggtagagagaaactggtgaatgaagaaaatgcatcatgatgattgcaggggaaacacttaatctgtggaagataataccttgttttgaggcatttgcaaatactttctgagacaccctgttccatgccaataatggatggactaacctcaaattgttcttatttgttcattaatgcaagtcccccaagggcttgctatgcaacactttattagcctggaccgagtaatatattttaaagcaataaaactacattattttaaaattattttttaatgtggactttccagccattgactgccctctctgataggtctgaattagtgagttttaattgcgtgtaaaagagcaatgaaatcatcattatgaaaatgatggggtgcctccttcatggcaggcactgtgctgggccttatcccactcagcctcactacacccaccatgtgggcaccccatgccttcactgcacagacagaactcacgttctgaggggttcaactccttgctaatgaatgggggagctgggacttaggcccaggtgtgtcaacctctgttggggctcagaaaatgatactccccaatatggtgctttgacgtgctggactaaagaagaagcctcaaggtctcttgac

SEQ ID NO: 107932 - DNA, 383 bp, Homo sapiens
ttttgaatatgaaaacttggactcatattttgggtggtctaattacgagtgtgtccgattgttttaaaatactggcagtttaccagttcggttttggccgtgaactccagcctgactttttaaaaatgtaattattccaaatatggaggtgcatttgttcttcctgaattgatgaaaggggctctcagtgtccccaaggccttcgggctgcacagagctgcttcaattgtttgcccgcgtccggctcacctcccaaagccagctctgcagtgcagccccagcccacagcccagccagtgagactcagaactgaatgtcaaaggagagagagagagagaagcaggctttgtttgcagccatggcccagggaggtgacccacagg

SEQ ID NO: 107933 - DNA, 396 bp, Homo sapiens
gctggacaggactgctcagtcattcccagaaacacacaaactgcctgcctcctcctgccagaggggctagcttcaaggaccatcaggagcagaagctgtcttagcctgctggcagaattcccattagattaaaacttgcacatttttccagaaaaactgcagcccaaataatcagcttcctgactttacatggcagaggctgccaaaagtcagtctccattccttcagtacctcagctgaccaagcagcaaacgaccccagctgccctgcagtcagcagtccaacaggcacaagtgcaacagtcagggctttccctgatttagacaacagccactcaccatgccctgttcagaggggcctggggctatgcccaacaccacatgtcatcccatcccc

SEQ ID NO: 107934 - DNA, 369 bp, Homo sapiens
tcgcgacgttatccaaagatgccattaatttccatagcatcttggatacaaataagaaaaatgtcaagagaggaaagcaaagcttttgacagtggcctcattaagtggaaaacatatttcctgtattaggatggggattctccaagggaggcttaagtgaggagacctcttcttcaaattataccaatgtggaaaggagttctgtttatttgaggctatagatttgtattgctctttggtttcctgtgttttggtacatttctgaggtggaagaattctgatgtctgagccctacccccagactaattaaatcagcacataatctgaaagtggggcttgggggattcccagttttaaaaatgcgttagt

SEQ ID NO: 107935 - DNA, 527 bp, Homo sapiens
ttgtatccagaatatataaagaactgttaatcaccttaacgcacgtaaaaatgggtaaaaaaaatctgaacgtttacaaaaaaaaaatatatttgaatggccaataagttccatgtaaacatggtcaatttcatgaaatatcagggaaatgtgaactaaaaccacaatgagataccaatatccaaccattataatggttgagttgaagaagactgaatataccaagtgtaaattataaatcaccaccaccaccgacatataatgtataccttggtgaggatagaaacaatagaacacatatatatttctggcgggaaagtaaaatggtagactttgggagacaatttggcaatttcttagaaagctaaacacttgaaacaggaattccattcctgggtatattcccaaatgaaataaaaatatatttctacacagtgacttacacagagttaattataacagctttactcttaatagctcaaaacttgaatcaacccaaatatccatcaacaggggaatgtatgagc

SEQ ID NO: 107936 - DNA, 417 bp, Homo sapiens
gagagcaggtgttcaggagtgaaaaaaacccagccaggctggcgtcgtggtcaagaatccatatcacaggaatccctgaccccagaggctgtcccctctggtcctgcccttgccatcccgagtccctcccgtggtgtccagtgagtgggtattcgcttgtacgtgtgctgagtgtgtcacaaagggggtgcagggacacctgccagtttcacactgccatctggagcacttgcagaggccctggcagtcctgacctggctgcactgctccgttgcttgttctccaagctgcgatcccaattcgctccacacgggcctggtcctacggtcttggtgctctgggttctcactttgtccagggccccagagctgagtctcttagccctgaggagttttattagaaatacgagtctagagg

SEQ ID NO: 107937 - DNA, 288 bp, Homo sapiens
acagaggcaagaaggtgattttcctgaagcaggtgggcattggcttgttacctgtaactggatctctggtcctcagtcgagttcctctacgaggaacacaccagaaatctgccatcgccacctccacaaaaattgctctcagcaatatgaaatcctcaaacatcatactgatgcttactttaagaagcagcagctgtggaagcccagccatcaggaaggtggggttttcaacaccaaaaaagagacatatgaaattacagagtagtgtaaggttgatcaggaagctgt

SEQ ID NO: 107938 - DNA, 889 bp, Homo sapiens
cctctcaaagtgctggcatgagccaccactgcacttagcttgttattattttcctttgccaaagattgcaaaattttgtatgttttaaataccaaacatttccacagaaaatgacttgctgccaatatctggtgtgtccgggaatgcaaactgatcttgtacctaatgcacatcatcacatatcagattctttgaatattggtaataaacataatttaaccaaatgtctaaatgttttagaaaggcaaaccacctgtgatttaactaagttatagtgtggtaatggagtgattctttttctttacatgggctaagagcaagagagcaatctttggacagaatgatctttctccacatgtgaagctagttgcaagcatgcccgcccttcagaacagtccagtgacaccagttctgtgttggcagttgagtaattcaaggtagaatgctgaattagaattcaatcctaatcctgctgcaagtgctggttttactgggtcatatcttggtagtcagaaaatgaccccacagccccacagttttacagatccaatatccgcccatcaagtcacacacatgaaaggcatcatgtcactagtgatatgcaaacatcaaatgtgatgagtacaaacaaaaaggacccacagtatacagtgaaattcttcattattgttcttttatcagtccttaatctctccaccctcatacatgaaatatcttacaataattttacatactgacacgggtgggtggagtcataagttgtgccaaactaaattgatttagacatgatgataaggaggatcatagaagagtgatgtattatcagaactgtaccacctcaattgtcgttggccattcagtgtattaatccaaaaaaagttggcggccg

SEQ ID NO: 107939 - DNA, 636 bp, Homo sapiens
ggagaatttgcattctatttagactaccctttggagcacttccaaccaaaagccctgctatgcagaggttcctgaatacatgttcattgcctggcaccagcttggctctcctggttggagagacacgggctcgttcctgtgtgtgccagctctctattcattccaggccacatactgggcttccctcccagagagccatcacctactctcacccttccagagtggtacatggaagaacagacaaatgctttaataagaagtgtgcagtttgggggccctacttaaagtattgggatcaacctcttcacggacagtgtgctgcgctcattactgatgacccatgctataggatgtagatggggtgaaatcacttcctgcttcaacacacgttcctcactggtgggtgttcacatcccaccactcttgctttagtctttttcaacccatgggggatatccaaccaaagtttctggtagagaaatcttcattttgcagaacttgttgcaatggtgtggttagtgttttcattttagtaaaatgatgtttatttctgacttgatgtcagtcttgggaaatccctctgttttcaaggcttgtttcaagaaaaacaaaatttgtccaaatccaaacatgtta

SEQ ID NO: 107940 - DNA, 169 bp, Homo sapiens
accacaggcaaagatctccatacatgcaaataggaattaacatatgatcctccagaacatgacagtaatttaaaacaatttccaattcatctttgaacttctttttttttttctttttgagatgaagtcttatgctgtcgcccaggctggagtgcagtggtgcaatctt

SEQ ID NO: 107941 - DNA, 776 bp, Homo sapiens
ctacatgaattacaaaacagaagaacccaacaggttgattatcaagatctaaacaactggcattaaaaaggaatctattaattgctatcatgaaccttaaagatattcattcagaacccaacctgatactttaaattgctgtgcagtttaattattttctattagcatagagaaatgaattggaaggtaagaagggagctatatctcctattgttaattgcaaataataatctacagtctgcttctgctacctgttgtcattcttccctaccagctaaatataaaagcacccatgcattgctcatctgcataaagagaagaaggaaagtctgatttgttattacaaaggggatttatttcaaaaaggaaagtgaagggatgacagataagtgcacttaaaccttttgagcattacagaaagcttgtagaattcgggtaactgaatgtaatctctgtattctccgttaacgatagagcctcttggacagactgaagttgtgcctggaaccataatactctctttatgccactgtcttccttcttagcaggccgaaaggcacacactcatggctgattcttctgctctccacctgctggcccccttgtgagccagagcttttggatctgatgtagccttttgggtgtttgcacaaagggctggcacatttgcaagtggtatgtctgcttgcaaagcagtgggacaccaaaaacattaaacacagattgtttggggtttaagcaaatctaagacaaacaagttgaatatctgagactat

SEQ ID NO: 107942 - DNA, 141 bp, Homo sapiens
tctaggcgggtaaggggcaagaagagacacaaagacttctttctagtggagagcgaaagagaaaggcgccaagctcagtggatgctgcatgaccacgagacctagagctggggctgtctgagcctcggagaacaatgagaa

SEQ ID NO: 107943 - DNA, 280 bp, Homo sapiens
aggctggtctcgaactcctggccttaagtgatctgcctgccttggcctctcaaagtgctgggattataggcgtgagccaccgcgcccagccacagttgctccatttttaattgaacttctgttgcacttgtattgacagtgtttatgggaactctcaaatgtgtcaccaaaaatctatatttgaaagatttccagactattgttctagagctaagttttaattatacacatctatctgtattgttaaaataaaaactttaaacaaattaaatttaacaga

SEQ ID NO: 107944 - DNA, 1075 bp, Homo sapiens
gcttcaatatacattcatgagagctaagtgccacctttgcactaaagggtggtctcagggcccgttctgtttgggtttggtagggacaggggagtgtggctcatatttccattactgtagcagaaattgctggtgtctgtggcagaggagggcacctaaggacaggaaaagagaaacatacttttatattcatagagcagctcgttgttcctgaatcctttctgttataaaggacagagaaatgggtggactttttctgcaggaccttccttctgtttgtgtgcgtgatggtagcagacaaaaaggtggtgctgacatttttaaaggaacgttctcaaaatgcaggtataacttgtccagagaatgttatctaaaaaggattttcagagaaagaaagagaaaaaatggctttttttcagctaaacgtgtctcagacgaagagctgtgtgcactctgcttcatggaatgccatgtgtttagtacttgcaaatctttacttctcgatttgtgtttttccttcttaaggagtttgttttaactacattaaaaaattcttataatattcaaggctgtctgcaaaacatttctttactatataccagagctttctctacattctctacatcatggcttcttatatgccacgcagaattcctaccataaatttataatcggcactactaaaaatgttccctttgtggctgttaaacatggggagatgtagatactcaagattcctattgggggaaagctggggtccctagtaaagatggagaatatgtaatgttgaggtttcatctgttttctctattaactctatgcagaacaggattaagaaaatgcttatttaaacagaataccatttattacccagaaagttctgaaaaaaattattaggagatacctgctctctagggtgctaaagaaagactacttaaaatcactgttaaaaataacagaacatgggagatatctgtattttgaactttgtataaaactgatgtatctttatggttgcattcagattataatttactgtttgaggggcaatatcttagcagtgatgccgtgttct

SEQ ID NO: 107945 - DNA, 900 bp, Homo sapiens
ctgcccgctcctggacatttccggaaggccccaggaaatggtggctgatagtggttcctgaggccacaccacgggctgcctggtgccctttccctccccagtgcccggctggagcaagaagccgagctcctgatgggagctggccctttctttagactttgcttcaccttcaggacagggggttctgaatttctgcgctagggccccgccggcttgggtgggcttccagcgtgaatcctcggcctgtcgtccccgtcatcaggaagcccaacagggcgcccgcctgccctctgtgtcctccccgggctcgcggccgtgcaccttctggtgctggatgagggtggacagccggctgcaggccctcccgcaggcgcggcaccggtatggcctctcgccgctgtggagccggtagtgctcgttcagcgtgtagctcctgcggaacgccttgccgcactcggtgcacgcgaagggcttctccttggtgtggatcttctggtgcagagtgaggttggacttgcgaccgaaggccttgccgcactccgcgcactcgaacggcttctcgcccgtgtgtaggcgcaggtgcagcagcagcagggagttgtgtcggaacggcctcccgcacaccgggcactcgtggggcgggtcccccgcctggggcctctgcgcagctccgagcagggcgccctgccccgcgccgccgtcctgggcaccctcctgcgcgtgcagccggtggtgcttcaggagcgaggaccctcggatgaagcgctgcccacaccgcaggcaccggtagggccgctccccgctgtggatgcggccgtgctcgttgagggtgaacctgcggcagaacgccttgccgactctgtgcacgcgaagggcttctccccggtgtggaacttctgg

SEQ ID NO: 107946 - DNA, 476 bp, Homo sapiens
gattggcagctccagcgtgatcccagttgttagagaaagggatgctggtgaatgaagaagcgcagatgtgcattgcagtgggggagctggaatactggcctgaactacaggtgcaggctcatattttgaccattatcatttgcattttccacctctccacttacgaatgttaattatctgaagctgctacaagaccttacatttatactgcagttgcaaatatagccatttaggtgacaaagggtccattctgctggtataatgctgtctttccacggccgctaaaaccatgcagagactggcatgcctatcaacttcccctctgcttcacggggattcagagcggatgttctctaagggaccttccagatgggcccattccgggtgccatgtcttggggaccaggtcacttccccagctgcactttttgccatcatttccatatgaagaagaagtagattggcttttagtttaag

SEQ ID NO: 107947 - DNA, 437 bp, Homo sapiens
atgcttcaaccatctatttttatggaaaatctaagggtcttaaccacatttcaggaatttaattaatatcatgttgtgtttaggaatgctggtttattcactagggtataaatgcaatttattttacagagcctgaagtctttatatgtttctatacccctggataaatctcaactattttagttgttgattttttttgatgttgcctttaaaaaatcaaaactatatttattactttatcaaaccaataggccatcaagctgtcacatgaaagactaaaagactgacttaatcacagcatcttcagatcaacaacaaatgctttccctgctacagaggctactgatttcaggacatgggaatcagaatagaggtcttgcataggactctacctgcctgagggaattaatacatgtaaaacatgttcagtgtgttct

SEQ ID NO: 107948 - DNA, 585 bp, Homo sapiens
aagaattgagtggagacctgctatgatacgcagtagaaaaatgagaaaactttagcaggaggagatagagagatagacgcacaatagaggtagaaggctacatagaaggtaaagtgaagattgttttggctttggaagacagaaaagttggactataacatgaataaagagaatttggaaactgacccataacattatttgggaaaactaacctggagtttaatattaatgtaacattaattgttgttaaatatcttagttgctgcctttcttaaaataaatttgatttttcagtataccagcacccttctatacaaatacataagaaaatcagatttttaataattatacattccttagataagcttaattagagctcagcttctcatcttggagaaacaagttctctgaagattgaagaactgaatgaagatactgagagaaaaaaaaaaaaaaaggaaattttttgggggttttatatcatgtaaatggtcaagtggaaaagcattgatacaaaatctggttgggagacctggatgtttattttggaagatattatcccttttttgaagaggttaatattta

SEQ ID NO: 107949 - DNA, 347 bp, Homo sapiens
ctttcacttttgagctatgatgagcaatgctgctataaaatttcttgtatgtttttgtgtagacatatattttcatttctgtatacctggggactaccaaacctatttctaaaacagctgcaccattttacattaccaccaacagcgtttaagagttcagtttctccacatcctcagtaatacttgtcattgtctgtctttttgatgatggccatcctggtggtatcttgtcgtcgttttgatttgcatttccttaataatgatttgagcatatttccatgtgcttattggtgcctcgtctgtctgcttttgagaaatctctgttcaggttctttgcccccttttta

SEQ ID NO: 107950 - DNA, 596 bp, Homo sapiens
cagaatctggagaaacgtatttgaatagtttggtcgggggatccttggggccaaggactttgcttgccactgtgcctgaactttctggcacacagagcacaatacatattgatcaaatgagtaaataaatgaattccagcagttttcaatattaagcatttagttccatgtttccatatgtctatctttgactactgatttcaacttgggacactgcagtctcttcaagaagcaagaatctttcactttttttttttctcctgatttattcttcctgttgtgtgtgtgtgtgtgtgtgtgtgtgtgtgtgccatttttagaccattttgaagtgtttttttaataacaggtgtattgagatataacttacatattacaaaggaaacccattcaaagtgtataatgcgatggtttctagtatattcacccagctgtgcagcaatcttcacagtgtcattggtgcaggaaacatgcaacaccacatggagcttgttgccacaaagatccaggctccaatccttgtgttcaccacttacaagcttatgatctttggcaagtttcttaaattcttgaggccttcgtttttcccagccgta

SEQ ID NO: 107951 - DNA, 461 bp, Homo sapiens
ttctcacttgtttctaaatagcattctagcgactcattagctgaatctaaagtacaagggattttgagaattaacattcctggcttctctcctgtgataccaagaagaacccagaaagaggtgatggtggggcttcactgagcacaatctggcacacttgcattctttacagcttttccaatttcttacaagataattttgcttattaatgaggggaaaacaatagtaataatgcactctgtatttagtgcacactatgtttaaacaatgcaaacatgaaatggaaattctgtcctactggaagaatatcttcaatacatcatgtgttctacctcctctcttccaaagccatgagctacttaaacattttcactggggtctcatgcagatctttaacacggatagtgactttgaaaatcatattagaatatatttggaaacatagttcataaaatgatgga

SEQ ID NO: 107952 - DNA, 438 bp, Homo sapiens
gctgtggtccccacatctacatggccttcgcatatcccccagtgaaaccagcgagggccaggctgccgccccagcaagagcttctctccacacctgccaggccctactcccctgcacctgctccaggctgctcctggctcagcacctcctcagagaagccctccttgataccccatactgggccaggcctccctgggaccccctgactcaacctgtgttatcctgttaacgtaacccatggcaggatcccacgtggacagcctgccttccctagagagaccgtcctgggaggcagagcctgtgctggcctcgttcttggctctgggcccactcaggcttcagggcactcacagggaaggcctctccacgcagctggcctcccggcatccttgtggcccatgtatggcctgtgcgtggacgggagacttgcaagagagg

SEQ ID NO: 107953 - DNA, 412 bp, Homo sapiens
gggtggtgaccagggagagtctgtgccatgtttcctcagaaatgtcagttttgattctttgagtgcccctgtcacaagggccagaggaggcagggttgtcttttaccctggctttgctggtggagacactgaggtctagttagctgatgcacattggtcagctggcagtaggcaacctgagaaggaaagatgtggactcctggtcaggtgacagccaagagcaatggagatttaaaaggattttcttactagctttccagttaaataatcttaaagcatcttgggcgatgcacatcacacaaaaaaatattcagataatgctttttctcttcctttatacaggctgcctaataccccaaaaagtaactataggcagcctgattttactataactcctggccctcttttttta

SEQ ID NO: 107954 - DNA, 208 bp, Homo sapiens
atattaaagattcattagtctctttgctctatactttgttcctcgtgtttcatacctcctctgcagcctctcattcgtgcactccagataccctggcctcctggtgctgttctaactcatggtgcatgctccttgcacaagctcctgccattagcacttgctcttctctctacatgggatgctcttcctccagcagaagcagaattac

SEQ ID NO: 107955 - DNA, 423 bp, Homo sapiens
cactatcttggctcactgccatttccgcttctggggtttaagtgatcctcctgcctcggcctcccagctactggggaggctgaggcaggagaattgcttgaacccgggaggcagaggttgcagtgagccaagattgcgccattgcactacagcctggggaacgagagcgaaatgccgtctcaaaaaaaaaaaaagaaaaaagaaaaaaagagcagcacatggaaaaatgcctttgagccaaatgccagggccacgtgagggccccagcagagaagcagtctgagctgcattccttgaattcccaggtcaaaggaggtgacagggccactgcctgtggagttggtcagagcatggccaaactgttgttttcccatgggacagcaggtttaagagtggtatcaaaaataaaggtacgtgtgttga

SEQ ID NO: 107956 - DNA, 589 bp, Homo sapiens
attctgctgtgagtcgacgtggtatgtgtctgttatgacgccacatttagcagtcgcataaggcctgaaagagttaagatacctccatatgtatgaattcaacagatagtctccagccaggccagagctcagtatacctttccttgtcttactgaatgttttggcagtcaacattgaatcagtgttttgaataagcaagacagtttattgctactgtcatttatcacatgttttgtagataaattctaatgctgcaagtgacaaaactccacctcagactggcttacataaaaaagggaacttggccgtgtgttggctcacacctgtaatcccagcatgttgggaggtcgaggcaggaggatctcttgaagccaggagtctgagactagcctgggcaacatagcaagacctcatctttaaaaaaaatttaaaacaaatagctggacacagtggcacacacctatagtcccagctactcaggaggctgaagcaggaggattgcttgagcccaggagtttgaggctgcgggtgagccacgattacaccactgcactccagcctgggtgacagaacgagaccctgtctcaaa

SEQ ID NO: 107957 - DNA, 412 bp, Homo sapiens
ttgcggggatttctaaggtaggaagaagaggtgtgtgtgtgtgtgtgtgtgtgtgtgtgttactgtgctacactcaggcatgtgtaatattttcctttagtttaggtcaaattctactattctaattattcctatagagagcttacattttctttgttcctctttataaagtgcctcaggtctctatctcaggtttttctaggtctttctgaaaattcttattacttaactttatccttggacattgcttatacataaacgtctgctaattctaaatgtcattacttaactccagaaattttccttagcttctcttctgaaataaatttcccattaaattaaactattttgttcagctaattctctcctttgtgattttatagaattcccatgatctgaagcaaagttaaaa

SEQ ID NO: 107958 - DNA, 349 bp, Homo sapiens
cttaaacctaatgaagatctaaagcttttacttagtatgtgaaacctaagtaatattttttattcttaataacaattaatatggatttttaaattaataaattataagtgctatgagtattcctcaccacccagctaaatagaatcctgtttttgttctagaaaattgactgtctgcatttgtaaagctatggttttgatgtactttgtatctagttcaggtcgtcactcatctgtattgaacagattgagtcctaaagagggaattgattgtttaggatcctgtaaataattatcggctgacactgaacccaagtcttttccattcagtttataatctttctgtaatt

SEQ ID NO: 107959 - DNA, 456 bp, Homo sapiens
gatctgaggatccttttgcggtgccttccacagatgggtactcagccaataaacccccttattttgtttggctaattcaagatgggcctctgtcacttgccaccagagggtcttgactaatgtactgtacctaaagtataatcccgcctttgttacaatacagagaaacagacgtagatgcagatgtaagtatattacgtgaaagggtgtgcttttgcatagaaaaaaaagaccacaaaaaaaatattaaacgttaatatctctacagtctcccttgtgggactgaaggtgatttttattttaatccttgtgcttttctgtgttttccaaattttctgcaaggaacaaggatttttaaaatataataaacatttctttcaaaaaccagattgtcaggcagggcacggtggctcatgcctgtaatcccagcactttgggaggacgaggcaggcagat

SEQ ID NO: 107960 - DNA, 593 bp, Homo sapiens
tccaaggaatcatctgaaatgattttgtagatagtttattgcaggttggagaagggagaaaatgaaggaaggggtagagggggcaattatcacgcatcgttttgctatcgtatttgcaaggggaagaaaatctcaatgcatacatggttcgaaagtgattatttagacagtaagcagtttccccaggaaagctcctcagagggtctcctcgcaggctgcagattctagaaagtctgcggaagagtagttcgcaggtgcatgtgtctgggcgaagcgctgcgtgtggctcagttggtggcagtctctgcctctgtccgcaggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggtgcgctgagaagtggcactccctctgcaacttctttgtcaatttctggaacggctgagactgcctgccggcttagggagggttgatgggggaggcgtggggaagggaaagctaagggcgtct

SEQ ID NO: 107961 - DNA, 592 bp, Homo sapiens
tgttaataaactaggatattatatttttattagtagtaacaattattaagattgagagtcttaagaaaggctattggaaataataggtaaaaatgtagaactcagaatatgagaaatagaatgtaaatgatataattgtgtaaaaaatgcctagtttagaatactgaagtttgttttgtttcattttatttaacttttaaaacttagatcttttgtttaatttttattttttggatggttaagtacatgaaagaagaaaaacttggttaattttgcctgattattttaaacattggaagcaaaatacaagatttgtatttcatactacaggaccgcttccatcatccatctggagagacagagagagagagggagagagagagagaagcgcggcggtgataagtctcccagtgtgagagaaatcggggaggggcgaagaagggtaggcctcttctgttccattgataccacgttcattcacagggagccggctaaaacagactactcccccgtgcagtcgttccctctaccctaataaggctttggcgcctctcccagaactcggtaagttcaaagtgtagtaaagtgcatg

SEQ ID NO: 107962 - DNA, 1240 bp, Homo sapiens
tccaaggaatcatctgaaatgattttgtagatagtttattgcaggttggagaagggagaaaatgaaggaaggggtagagggggcaattatcacgcatcgttttgctatcgtatttgcaaggggaagaaaatctcaatgcatacatggttcgaaagtgattatttagacagtaagcagtttccccaggaaagctcctcagagggtctcctcgcaggctgcagattctagaaagtctgcggaagagtagttcgcaggtgcatgtgtctgggcgaagcgctgcgtgtggctcagttggtggcagtctctgcctctgtccgcaggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggctgctcggagggagaaaggggcggctagcaacgtggcggagccggtccccgggcccactggcggctcctcgggtcgcttcctcagccccgagcagcacgcgtgcagctggcagctcctgctgcccgccccggaggccgcagcgggcagcgagctggcgctgcgctgccagagcccggacggggcgcgccaccagtgcgcctaccgcgggcatccggagcgctgcgcagcctacgccgctcgccgcgcgcacttctggaagcaggtgctgggagggctgcgcaagaagcggaggccctgtcacgaccccgcgccgctccaggcccgcttgtgcgcgggcaagaagggccacggcgccgagctgcggctagtgccccgcgcgtccccgcccgcacgccccaccgtcgcgggattcgcgggggagtccaagccccgggcccggaaccgggggcggacccgggagcgtgcgtccggcccagccgctgggaccccgcctccccaaagcgcaccgcccaaagaaaacccctcagagaggaagaccaacgagggcaagaggaaggcggccttggtccccaacgaggagcgacccatggggaccgggcccgaccccgacgggctggacgggaacgcggagctcacggagacctactgcgctgagaagtggcactccctctgcaacttctttgtcaatttctggaacggctgagactgcctgccggcttagggagggttgatgggggaggcgtggggaagggaaagctaagggcgtct

SEQ ID NO: 107963 - DNA, 1484 bp, Homo sapiens
tgttaataaactaggatattatatttttattagtagtaacaattattaagattgagagtcttaagaaaggctattggaaataataggtaaaaatgtagaactcagaatatgagaaatagaatgtaaatgatataattgtgtaaaaaatgcctagtttagaatactgaagtttgttttgtttcattttatttaacttttaaaacttagatcttttgtttaatttttattttttggatggttaagtacatgaaagaagaaaaacttggttaattttgcctgattattttaaacattggaagcaaaatacaagatttgtatttcatactacaggaccgcttccatcatccatctggagagacagagagagagagggagagagagagagaagcgcggcggtgataagtctcccagtgtgagagaaatcggggaggggcgaagaagggtaggcctcttctgttccattgataccacgttcattcacagggagccggctaaaacagactactcccccgtgcagtcgttccctctaccctaataaggctttggcgcctctcccagaactcggtcctggggaatgctctttgcctggtccagccccgacaaacgtggtctgagaacagcggagcgcggaaaccgcggagcatgactcctccgaagctgcgagcgtcgctgtcgccgtcgctgctgctgctgctgagtggttgcctcctcgcggctgctcggagggagaaaggggcggctagcaacgtggcggagccggtccccgggcccactggcggctcctcgggtcgcttcctcagccccgagcagcacgcgtgcagctggcagctcctgctgcccgccccggaggccgcagcgggcagcgagctggcgctgcgctgccagagcccggacggggcgcgccaccagtgcgcctaccgcgggcatccggagcgctgcgcagcctacgccgctcgccgcgcgcacttctggaagcaggtgctgggagggctgcgcaagaagcggaggccctgtcacgaccccgcgccgctccaggcccgcttgtgcgcgggcaagaagggccacggcgccgagctgcggctagtgccccgcgcgtccccgcccgcacgccccaccgtcgcgggattcgcgggggagtccaagccccgggcccggaaccgggggcggacccgggagcgtgcgtccggcccagccgctgggaccccgcctccccaaagcgcaccgcccaaagaaaacccctcagagaggaagaccaacgagggcaagaggaaggcggccttggtccccaacgaggagcgacccatggggaccgggcccgaccccgacgggctggacgggaacgcggagctcacggagacctactgcgctgagaagtggcactccctctgcaacttctttgtcaatttctggaacggctgagactgcctgccggcttagggagggttgatgggggaggcgtggggaagggaaagctaagggcgtct

SEQ ID NO: 107964 - DNA, 518 bp, Homo sapiens
aatactggagaaggaatttggagattgcattaggccgttcttgccttgctatgaagaaatatctgagactaggtaatttattaaagaaaagaggtttaattggctcacagttctgcagggtatagaggaagcacagtggcgtctgcttctggggaggcctcaggaaacttccaatcatgacaagaaggcaaaaggggaacaggcacatcacattactagaactggagcaagagtgagagagctggcgaggaggtaccacacacttttaaatgaccagatctcatgagatcactcactgtcttgaggaaagcaccaagccatgaggaatccgcccccaagatataaacacctcccaccaggcctcacctctagcactggggattacaattcaacatgagatttgggcagggacaaatatccagactcttatcagaaatgatccaggatagagcagcagcggggaaattaagagacatatagcaaatgccaccgtgcttaagcgttgttggcaaccacaa

SEQ ID NO: 107965 - DNA, 328 bp, Homo sapiens
tttcataagatcagtggcagggtcggagccaggactcaggataaacacaatgggcgaatgtggagtgctctgctcaaaaatagcttcaaagctgatcattgggggctgcacatacctggtgaaagaaacacagtcagaaaactctcccgcgaggacagctccagaccaggggctggtctgtctgatcagcgctgcctcctccggtgtccagaaccttctgaccactcctctgggatagctcgttgcagtcttccctgttttagattctagtttctatgcacgtctcccaccctgatggggaactcctgagtggcagggacttctctgt

SEQ ID NO: 107966 - DNA, 111 bp, Homo sapiens
ggtctctgacacccactcatgatcctgtcacagtgacacaccagcccaccgcagttcccactactgttccttcgtgggctccaactctcaaagcagcagacatcttttctg

SEQ ID NO: 107967 - DNA, 251 bp, Homo sapiens
ctctttttacccctaattgagaggcgtgactagaaggcagaaagctggctgttgaggtgggagtctctctcttcaggcagaggtagggccgcttcctggggcagaggcgtggatggtgtgtctggctctgcagttcctgatgaagacatactggggtgcccaggctaacctttggcaaaactaggagctgaactcaggagtccctgatgccagcctttctgatgcggtcccccctcccctcccccatgtgt

SEQ ID NO: 107968 - DNA, 313 bp, Homo sapiens
ctcagacacaagggaagagactctgctgcttcctgggagaagctgcaagaccacattgcgaaggaacatgttgttgctgctcccatgttaccttcgtcagtgacctgagatgcagactggatctagggaatggtgtttcctgtgtgatgccttccaggagtatctgcaccacgggcagtgccaggccgaggacagagggcctaatggaggacactctacaactccatcctgctgctgggggggcttgggggcgcctccacgagggtcttcagaggaaaggcatgtgtgtggtctgtggcctgccagcaggaga

SEQ ID NO: 107969 - DNA, 461 bp, Homo sapiens
ggaacagttggaaatgcgtttcccaaccttgcctaaccagctgccctggaatgttttccacttcctgggtcattgcctccagagatcaaagcccccatccacacagtgggctgaatatggatccatgcagcgatctggtcctggtgctgtggaatcagctttgcacaaggccccagaaggtctgcgttccagagccttcctgttggggcctcagtcttctcatctgaaaaatgggagcaaactcagttctgccatgcccagtgtgggtgtgatgtcacatcagatggagtctcgctctgtcacccaggctgaagtgcaatggcaagatctcagctcactgcaacctccacctcccagtttcaagcgattcttgtgcctcagcctctggagtagctgggattacaggtgcccaccaccacacctggctgatttttgtatttttagtagagacggggtttcac

SEQ ID NO: 107970 - DNA, 346 bp, Homo sapiens
gccgaactactactactaaatttgcggccggtcgacaatcagaggtgtaataagttatcaatttttaacttcttttggaagccataggagctctattatcagtttttgaaatcagtgtggtactcatatcctttcattacttttcctcattattgaggtctaccctgagctctctaaataaacctgaaatatcttccacctgctacattctctgcgccctccatttcagctctacattattccagtggcactctcatcattgtataatatgctaaataacttgtttatttttacttttataactttttcctagaatacaagtaatacaatggcttggacatttgtt

SEQ ID NO: 107971 - DNA, 1687 bp, Homo sapiens
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagctgaaattgcatcttaaattgctgttgttcaggattgaagtcttgttcttctaaagagaattttcatttgtttctgccaggcatttggggacactaccaaccggagaccacgttaaagtttttgcttgtttgttttgttcatttgtttttggaccacagtattagctttaatttaggctgcagatctgctcaaggttcagttctcaggaagattttttgcttctcctttctacctaagggcaagttgagaaatacaaaattctttgctttccctttctgcatggctaatttatttctttaatcttacactgagggcatagccctttggtaatgtatctttattcagtagcattctatactaatattaacacacaagcataaagcttttttctttcttatggtatatatagtaatgttgtgtcttttaattgatggcagtttagatttgatagaattcaataatagtcatattctctagtatgaatattaggttctttgtaatttgttcccgctttctcctttaacgtcatttatttttgctcttcccttcactctgtgtaccatagggactacgaaaattaccctcattcaccttctttcatatttaacatttccttggatgtgctattgaagtcttctttcccttcctatagctcattaaagacttaactcccttatgaaagccaccttgacttttctcactctacctgtcttctttgcttatcgtagtatcttttacatacttctgttagagggactcaccatactttattgcaattatttgtaaccattctttctctccttttagactgtgagctccttgagggcaggaactatatattttattttcttttgtgttttcagagtaaagtgcttggtttatagatgctcaataaatgatgtgtttgtcgactgaattgttttaaaatggctttaaaaagtcttttggtggtacagccattttccacagatttcttttctctgaaatagtctagagaaacacacatgcgaaaattatttatgtatatttttttctcctgtgttctttgactttgagtcctattagctttttgaatttgcctttaccttctatcagtcaggaaggagataactattcataatagaaattttaaggatctctcttaagccaaagtatcaattattttgtattttgataatattgcagttaggcaggaagaccatttgtaaaaaccattctaggaaaccaagaactaaaaatcgggtgtaactcatgtgggtcaggcccatcgaatacaataaacattattcttgtgttggtttttttcatttcattttattctattattgtaaaaaacaataaaaataatagaaatt

SEQ ID NO: 107972 - DNA, 4556 bp, Homo sapiens
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggacatgctgcatatgtgtttatttcacaatgtgcacacagtataagtgaaaatttaagggagatgatagcacttaacagcacttttcatgttcacatgctttccaagcattaatgaaaagaactataggaagctcatctgtgggctctattgggtttcagataatccaatataaactacctttgatatgaaagttcgtaagatattttacagaatgtaagtaatttgcagtatcgcagtcattgaaatgtcataagtgagcctcattttataaataaaagtttagagtagaattatattgcaagggggttttgtcaagtaagtactgggaaatgtaaatatttttaatgaatacaattaaaaccatttcaaacttacataattttatactttacattttttatatctgcagtcctgaaagttgtaaattgaaatgtcagttgaattaatgggccaagatttctggtgaaagtggtttttattcaggtcctaaatgtgtaaagcaatttatggtcaaaaccatagaaaaaatactaattttgtcttggttgtgacctgataggatccatgctcgtttctgccatactacctctggagttactcattgctgattatataaaggaaataattttgatttgatatgtattatgactgtgttcattctgcttatagttggatgtatctccttgctattaagaacttaaaacaactttagtgccaattgcagagaaagcttttttccccattttactgaagtaaagcatgaagtgaatttgccttatgtgatatatatgttataaataagtaaaacaaaagaattatccatttgtacggtttctggaggtggtggcaaatccagaacttataagactgatgaccaattgatttgttccttttgaagtaaaatagaaacgtaagcctt

SEQ ID NO: 107973 - DNA, 4498 bp, Homo sapiens
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctatgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggacatgctgcatatgtgtttatttcacaatgtgcacacagtataagtgaaaatttaagggagatgatagcacttaacagcacttttcatgttcacatgctttccaagcattaatgaaaagaactataggaagctcatctgtgggctctattgggtttcagataatccaatataaactacctttgatatgaaagttcgtaagatattttacagaatgtaagtaatttgcagtatcgcagtcattgaaatgtcataagtgagcctcattttataaataaaagtttagagtagaattatattgcaagggggttttgtcaagtaagtactgggaaatgtaaatatttttaatgaatacaattaaaaccatttcaaacttacataattttatactttacattttttatatctgcagtcctgaaagttgtaaattgaaatgtcagttgaattaatgggccaagatttctggtgaaagtggtttttattcaggtcctaaatgtgtaaagcaatttatggtcaaaaccatagaaaaaatactaattttgtcttggttgtgacctgataggatccatgctcgtttctgccatactacctctggagttactcattgctgattatataaaggaaataattttgatttgatatgtattatgactgtgttcattctgcttatagttggatgtatctccttgctattaagaacttaaaacaactttagtgccaattgcagagaaagcttttttccccattttactgaagtaaagcatgaagtgaatttgccttatgtgatatatatgttataaataagtaaaacaaaagaattatccatttgtacggtttctggaggtggtggcaaatccagaacttataagactgatgaccaattgatttgttccttttgaagtaaaatagaaacgtaagcctt

SEQ ID NO: 107974 - DNA, 3478 bp, Homo sapiens
  misc_feature (3312)..(3312): n is a, c, g, or t
  misc_feature (3317)..(3317): n is a, c, g, or t
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacatagtctagatatcgagccatcccaggtgttgggcgtggngaggnctactgctccttcctcttttcaactcttctcacatttcctcccgctgcctgtttttcccgcccctttccttccttttcttcattcctccgccctccctgctctctttctttttcgtttcttctcctcaatctctctttcttttcaattataaataaataat

SEQ ID NO: 107975 - DNA, 1315 bp, Homo sapiens
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccaagatccactaccggaagaagaaacagctcatgaggctacggaaacaggccgagaagaacgtggagaagaaaattgacaaatacacagaggtcctcaagacccacggactcctggtctgagcccaataaagactgttaattcctc

SEQ ID NO: 107976 - DNA, 618 bp, Homo sapiens
agtctgttatgccaacactctttttttttcattagatacctgttttatcctcagtaatttgaaacatcatttccattatactctgttcttgagcttgtttctcaattcttaattttggcaaagtttctcattatgccaccaaactaccatgtcaacatgtatatgtcatcttttttatagctgctattttatattctgttatacattttcaaaataagatatttcttaacgtttttactgtttaaatcatatataaagcaaaattttattttttcttccactgtgcagtaagtctctgaaattaattgtggataccttctcctgagctcccctttagtcagtgcactgtaatttagaggtagtctgcagtcaaatatgatgaacaatgtataatttcataatttctcctgagtttgaagaatttttctttcttttctagcttttaatctagacaacgagcaaccagattatgatatggattcagaagatgagactttattaaatagacttaacagaaagatggaaattaagcctttgcaatttgaaattatgattgacagacttgaaaaagccagttctaatcaggtactgtaccatgtaaagatgtctcttatcttc

SEQ ID NO: 107977 - DNA, 3627 bp, Homo sapiens
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatc

SEQ ID NO: 107978 - DNA, 4734 bp, Homo sapiens
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatcaaaacatggacatgctgcatatgtgtttatttcacaatgtgcacacagtataagtgaaaatttaagggagatgatagcacttaacagcacttttcatgttcacatgctttccaagcattaatgaaaagaactataggaagctcatctgtgggctctattgggtttcagataatccaatataaactacctttgatatgaaagttcgtaagatattttacagaatgtaagtaatttgcagtatcgcagtcattgaaatgtcataagtgagcctcattttataaataaaagtttagagtagaattatattgcaagggggttttgtcaagtaagtactgggaaatgtaaatatttttaatgaatacaattaaaaccatttcaaacttacataattttatactttacattttttatatctgcagtcctgaaagttgtaaattgaaatgtcagttgaattaatgggccaagatttctggtgaaagtggtttttattcaggtcctaaatgtgtaaagcaatttatggtcaaaaccatagaaaaaatactaattttgtcttggttgtgacctgataggatccatgctcgtttctgccatactacctctggagttactcattgctgattatataaaggaaataattttgatttgatatgtattatgactgtgttcattctgcttatagttggatgtatctccttgctattaagaacttaaaacaactttagtgccaattgcagagaaagcttttttccccattttactgaagtaaagcatgaagtgaatttgccttatgtgatatatatgttataaataagtaaaacaaaagaattatccatttgtacggtttctggaggtggtggcaaatccagaacttataagactgatgaccaattgatttgttccttttgaagtaaaatagaaacgtaagccttccttattttgttggttgtaactgtttcatggatggcatttcagttatgtacatacacattttccactgcttctctaaaacttaagtgacaaatatttgttttcactttattaaattgaagaatagtctatttctgcactggacagcactgctctcttagttttctcaggaaattagtg

SEQ ID NO: 107979 - DNA, 3865 bp, Homo sapiens
  misc_feature (3762)..(3762): n is a, c, g, or t
  misc_feature (3828)..(3828): n is a, c, g, or t
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtcaacgctccctcgtacttgctcttgcttaccggaagctctcttgcccgttacttctacctgctctaattcggccctgcacgcatatgagtccatttcacagagtaaccccacgcacccctcaattcttcatgtcgacgctcgctcttataagctccttctcaagcttcatttgctgtagtaagctatgaacgctgttgcagctgttcgcacgcccatcttctgtcgttaattttcatatcacggccgcacnctcttaacgtcccttccacttgtctgctagctttatacgtactaaacaccccaaagttcctctccnccctcccttgttatcccgtatctttcccaccttatag

SEQ ID NO: 107980 - DNA, 1608 bp, Homo sapiens
cctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagcgcatttggggacactaccaaccggagaccacgttaaagtttttgcttgtttgttttgttcatttgtttttggaccacagtattagctttaatttaggctgcagatctgctcaaggttcagttctcaggaagattttttgcttctcctttctacctaagggcaagttgagaaatacaaaattctttgctttccctttctgcatggctaatttatttctttaatcttacactgagggcatagccctttggtaatgtatctttattcagtagcattctatactaatattaacacacaagcataaagcttttttctttcttatggtatatatagtaatgttgtgtcttttaattgatggcagtttagatttgatagaattcaataatagtcatattctctagtatgaatattaggttctttgtaatttgttcccgctttctcctttaacgtcatttatttttgctcttcccttcactctgtgtaccatagggactacgaaaattaccctcattcaccttctttcatatttaacatttccttggatgtgctattgaagtcttctttcccttcctatagctcattaaagacttaactcccttatgaaagccaccttgacttttctcactctacctgtcttctttgcttatcgtagtatcttttacatacttctgttagagggactcaccatactttattgcaattatttgtaaccattctttctctccttttagactgtgagctccttgagggcaggaactatatattttattttcttttgtgttttcagagtaaagtgcttggtttatagatgctcaataaatgatgtgtttgtcgactgaattgttttaaaatggctttaaaaagtcttttggtggtacagccattttccacagatttcttttctctgaaatagtctagagaaacacacatgcgaaaattatttatgtatatttttttctcctgtgttctttgactttgagtcctattagctttttgaatttgcctttaccttctatcagtcaggaaggagataactattcataatagaaattttaaggatctctcttaagccaaagtatcaattattttgtattttgataatattgcagttaggcaggaagaccatttgtaaaaaccattctaggaaaccaagaactaaaaatcgggtgtaactcatgtgggtcaggcccatcgaatacaataaacattattcttgtgttggtttttttcatttcattttattctattattgtaaaaaacaataaaaataatagaaatt

SEQ ID NO: 107981 - DNA, 344 bp, Homo sapiens
tgcagtgcctcaaaaacagtagttgctcagtaaatatttagtgattcgagatctattcaattctggtgggttaagagaggaaagaaaagaatcagctatgccacagaagagttgaggagagctcaagacagagtttaaaagccattgagttaagattcctattttaacaatcttttatatcctgaggaaacacccacagagtaatagaattaaagaaatgcatttctctcccacttccaaagccttcagaaatataggcacttagacttagaaaaaagtactttgtattaatacatctgttatctatgcatacatatgcaaatgtgtgttaatatgtgagtgtg

SEQ ID NO: 107982 - DNA, 348 bp, Homo sapiens
ctccagcccaatgttttctacggcatatttcaaggagagctgcaaagtgtcaggttaatgccagcagcaattcttgtgaaccagcaaatgtctgtccagtctaagccccagatatgacaggaaactgagtttgttttattgtcaagactgcaccaaaagtcacttaatgtttgtatactatttccgctctccaaatctaatcaaataaatactacccaataaatttagaccccactaaatctttatatctgaatatcatatttattcattcaataaacacttattccacacctcctacatgccagacactgccagctctcagtcacaactgaaaagattgataataaa

SEQ ID NO: 107983 - DNA, 330 bp, Homo sapiens
aaactatataaaatgatttttaataaagtataacacaaacatgagttacagagaatagaatttttcacgaatcctgaaaggatgtcttcttttctaaagaaaaaaaattatctagcaaaaataatccttatgtaatcttaggataactttaagtttgctctaacatatcattaccaaagaatgttagttttttactctttcatccttttatgtgcccaaaacttactattttaaacagtctggatggcaaacatcttagtaaatccatggccacacttcactagacgatttattaaatatagcttcacctaatcttgatgacccgcaatc

SEQ ID NO: 107984 - DNA, 660 bp, Homo sapiens
ctagacacaaaatggagccagcacagggcgcgtctcggcgcatcctcctcagcccaggccccgtgcgtaaggagcgctccgtgtcagcgcgcttgctagaccccattgctgttgactttaatgtgaataggaaataagttttgatgtttgtttgttttttaagtggggctcctgttttttaaaaatggatcaatttacctggagtgcaggctgctcctgagcttgaaggtggaagtcagttcatgcgtgaaagaagtcttgcctaattgaaacatggcatcacggttaataattaaaatgttatctgatttgagatcagctgtttttgtgagaatgctaatgtggcattcctgattagtctgtatgtttgtttgtttgatttttaattctgggtgcagaggaacacagattatcaaatccagttggtatttcttatgccactatagtacaacttgaaatcccttttaagtagaggaaacagtgttgtattcatttcctattgctgttataacaaattactacatatttgagtagcttaaagcaacacagatatattatcttagagttctggaggtcagaagtctagaacaagtgggccttccttctggaggctctagggcagagcccctttccctgccctttccagctgctaggggctgc

SEQ ID NO: 107985 - DNA, 407 bp, Homo sapiens
tgtatcttttaatccatgaatcacccctctgttgcttttttcctaatttatttgtggaagaaagtaggccatttgtcccacagttttcccatattctgcattttgctcattgtgtccacgcggtggtattgctttgtggggagattttactctttgctaattagttacatttctagtcatactttctatttattcttgagtcagctgccatgttacacttttccacaaaactattttatccaatttttcaaattcatgggcagaaagttttccatattctatatttataggtttttttaaatcttcattatatctatagttgtattttttcattcctaatatttatgccttttctttgatcaatcttgccagaggttagggttatagatcttaatcttttcaatgaa

SEQ ID NO: 107986 - DNA, 1643 bp, Homo sapiens
cacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgttctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtaggaggcggcgataggtgcagcaaagggcagccacagtgttgattccacattataatgttgttgcctcttcttggcaaaagacaccacatggtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgactgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggccttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcc

SEQ ID NO: 107987 - DNA, 412 bp, Homo sapiens
tgggactcctgcctgtgggactgctgggctgtttgtcctggcaaatactcaggaaggctttgcagccattagactggttccctggattctttatctgaaaatcagatattattggctgttaccaatgaatgtccaaagtgatggtcgagaaaaaagagcgatttaaaagacataagcaaaactaaactatctttttaaaaaaggaaatctcaaaaaacacttgtatacttcaaatactaactcaaggaggttatacatttattccaatgatgcgactactacagacatcattttcagaactatttttctggaaggttttccagataccatttgggatcaccagcaaaaaatgtcttagtatgatatagtcacatttcactgacccaaaatggcaaaaaattcaactttcaca

SEQ ID NO: 107988 - DNA, 455 bp, Homo sapiens
aaagtcttcccatagatttttacatagctgctgcatttgtcatccctttcctgaagagctttgttgctgtggtcttgctctagggctgctttcagcaacatttctgacgcaggtttaatgctgattagccctaaaacaattctagggcagggctccctgccaggataaagaatgaacaaaattggtttgcatataggccagctgcagttgctgcagctagagtctgtcaaactaggaccattttcttgtttaccaagatgaggttaaattagcacagcatgaggcaaaaaaaaaagatttaaaaaacccagaaaattagctatgcttttgagtatgatgcagtgagtgtggaattaaggtgattttaagttagtttgagaagggaaggtaatatacagtactaaaagcttgattaaaagctgcttgaagatatttgcttgctaactatcttagta

SEQ ID NO: 107989 - DNA, 341 bp, Homo sapiens
ggccgagagtagatcttaaaagcatttaccacaagaaaaaggtaactatgtgagataatgggtatgttaattagcttgattgtggtaatcatttcacaaggtatacatatattaaaacatcatgttgtacaccttaaatatatacaatttttatttgtgaatgatacctcaataaagttgaagaataataaaaaagaatagacatcacatgaattaaaaaactaaaaaataaaaaaatgcatcttgatgattagaattgcattcttgatttttcagatacaaatatccatttgactgtttactcttttccaaaacaatacaataaattttagcactttatc

SEQ ID NO: 107990 - DNA, 279 bp, Homo sapiens
caatgcgcccagccagactcatttctaacagtcttctaaagacactgtctctgggaagaccaatgaaatcgagaaaaagtatcttgaagctgctagcccacctccaacaggacaaagcatgcttccagagggagctttcccatagctccttctaggagctgctatttactgggcattcactgcagaccagaccctggctgggcacttcttacgcctgttctcacctcatctgcctaagagcgctgaagtcaggaactatttgcttcaattttttttttt

SEQ ID NO: 107991 - DNA, 511 bp, Homo sapiens
cgagacatgatacgaatcgagccggtaccggaagcatccctaacagaagtctctgaaacatcagcttttcgtggagtgcgcggcatgtgtccaccgtcaagatgtggtagattgcatgtaacttgacccgctggagatccgggtcctttgcagtttttcatcacggtgcatagtctgggtaatttcttctttaggttcacttccaagaagtggaattttgttcaggacagtgcttgttttcacacagctttggagagtttgtcctccgttgttactttcctcaaaggttagaatgctcagactctcactttcatttgagttaacttggggggaaaaaaaggttcaacaccactgcattccagcctgggcgacagagcgagacttggtctcaaaaaaaaagaaaaaagaaagttaaagtggctgtctgatatcatggtttttctggagtgcagatggtgatgataataagttaaacttattcatgaacatttcctcgatgctttaggacccc

SEQ ID NO: 107992 - DNA, 150 bp, Homo sapiens
cagacaaaaatatagagacttctaggcaagatggagtaacaggaatttcattttctgctggaaacaacacatgtgagttagtaatcatcagaacttcttaatgagagaaagtctggggaccatggctaatagaggtaaaatcaaggccaa

SEQ ID NO: 107993 - DNA, 368 bp, Homo sapiens
aactcctgacctcgtgatccacccgcctcggcctcccaaagtgctgggattgcaggtgtgagccactgcacccagccgcaggtttggactttttaaaagcgtgtgtttgcctcctgtctcctccatcatgatttagagttgctttttctactgtattttgtttctgggtatcttctttaccaacagcatgtgctctttaccagtcaaatcattgctttatccagttgccattattcatccctatcattctctgttttcccctctctcttctattttcagttatttaattactgtcaaggcatcaacagccaagcacagaactcctttcatttttcccagtcaacttagtagtcagaatgtcaggtgta

SEQ ID NO: 107994 - DNA, 360 bp, Homo sapiens
gaagctaataatgctggttgcctgtaaggaaatggaatagccaggctccaatggtaacagagaaacttctttagattagattctttacattttgacccatatgatagctaatttaaacaataattaacacagtttaaaagtataggatcattaatagatagttggagaaaagaataaatggagaccaagttactggccaggctttatgtataaattttctaatagaaagaaggagctatttgggggtgctaaggcaaggggattcctctagcccaggagttttagaggctgcaatgaattttgatggtgccactgcactacagcctgggtgatagtgtaagacccagtctcaacaacacc

SEQ ID NO: 107995 - DNA, 537 bp, Homo sapiens
tggtgcccttgtaagaagagacaacagagatctctctctctctgtgagcacaaagagaagaggccatgtggagacacagggagaaagcaacagtctacaagccaggaagagagttctcaccagaaaccaacttgatggcaccttgctcttagacttctagcctccagaatgggcctgatgcagaagtgcttctccttccccttgcccctggacctgagccggagctgtctatctacatgaggacaccatctggcaacactgaaatgttgccctcactgtatgccatcaccaggaagacaagcaatagatgatgagtgaaaataaaatgtttagttggaaactatttgggaatggctttatgtccacatatggacacagcctggctggaactggggagatcttccctttctggtgtcttttcaaggtcttgagatgagctctaacaaatatctcaggccatctggcctagtttttcataattgtgactcctaaatgtaaacacggtccgagagaatatcgggaacaaaaaaaaggcta

SEQ ID NO: 107996 - DNA, 429 bp, Homo sapiens
gaggtaaaaactcaagcagctctctgctgctaccctgctcccagccaagaagataagggatttcaataggagtaaatgagacaacatgttatagctgaggattttctttcaaaaaggtaccataccttttaaaccagtaaggttctttgctgtacacagttaatatatgcctagaaggttataagttgagcagcctttgcatgcctggaacctgacagatctcaacagacacctgggaagcccactgtggcttttaaagaatgcatatttctggctgggtgcggtggctcacacctataatcctagcactttgggaggccaaggtgggcagatcacttgaggtcaggagtttgagaccagcctggccaacatggcgaaactttgtctctattaaaaatataaaaattagctgggtgtggtggtgcatgc

SEQ ID NO: 107997 - DNA, 222 bp, Homo sapiens
aaaagtaatatgaatggtgcctatcctttcaaacccgttttttactttattatgacagtaaagtctattataataatttatcttaattattaattatatggtttttggaactaagattatgtatgcatatgggaagtacatgtgtgtatttaaatttctgcttgaaaaagtataggttttttgctttcttgttttttcttcaaagtttcttggacacatttt

SEQ ID NO: 107998 - DNA, 266 bp, Homo sapiens
ttgttttttagtatgaactccacctggtatgttaaaatcatgacactcctaaattattttcatttgcatttgtatcttataccttttctctatcttttaaaataccagtctttcacaatcactgccttaggtgtgtaccttgtataaaccagagagtgggttttgccttgaatctaagctaaaaatattttccttctaaaggtgagttaagcatattaatatcttttttaagaaaggcatgtttgggccgggcatggtgactcaca

SEQ ID NO: 107999 - DNA, 773 bp, Homo sapiens
acctggccaatgtggcaaaaccccatctctgttaaaaatatcgcaccactgaactccagcctgggggatagagcaagattctgtctccaaaaaaaaaaataaaataaaagcctaggacctgatggctttagtgctgaattctaccaaacattaaaaaagctctactctaatacaaatttttcctaactatatataaaaaaattgaagagagaattctactaaacttattctatgaagccagcattattttaataataaaaccagaaggaaaaaaaagaaaactacaagtcaacatccctgatgaacatagatgcagaaattctcaaccaaataccagcaacctgagttcaaattcaacagcacactgaaaagattagtcaccatgatcaagtaggatttatcccaaggatgcaaggatggtgcaatgtatacaaatcaaaagcatgatacatctctgatatggtttggctctgtgtccccacgcaaatctcatcttgaattgtagctcccacaattaccacatgtcctgtgagaaaccctgtgggaggtgattgaattatgggggtgggtctttcctgcactgttctcctgatagtgaatgagtctcacaagatcagatggtttttaaaaaacgcgagtttgcctgcacaagctgtctctttgtctgctgccatccacataagatgtgacttgctcctccttaccttcctccataattgtgaggtttccccagccatgtggaactatgagttctccattaaaactctttcctt

SEQ ID NO: 108000 - DNA, 480 bp, Homo sapiens
tgcatagtgaccagttatccagtactaagaaagtactaaagaaggcactaaaaattatttttccttcatagtaataatagttctatttgctcagaagagcccatcccttattacatacccccttcgaatccactggtcaggatgcctaggctgcaccttctcttcccatggctgatccctacctccaggaatgaaaaaggagctctccaagggtcaccagttgggtagctgaggccaccagggaagtggctggcatggccaaacctaacatgatcatcagtgtgactggcgatgtgatcaccattaaatctgaaagtacctttaaacatactgagatttccttcatactgggaccggaatttgacgaagtcacttgcagatgacaggaacagtcaagaggcgcataaccttagaatgggggtgtccctggtccacatgtgcaggaaatgggatggaaaatcaatcaccaatatggagaaa

SEQ ID NO: 108001 - DNA, 141 bp, Homo sapiens
gcttgtaaacattgaccactctcagaaggggatgagggtgggagaggggtccccctatacttcctcacagggttaaggcctctccaggtccctgggccccctaattccaaagcttcttagctggaggtaaagagcagaaag

SEQ ID NO: 108002 - DNA, 878 bp, Homo sapiens
gaaatgttaccactacagaaagccaccaaacaacaatgctaaacattaacagagaaaaaaaaagatatagaaaacaagcagaaatcaattaataaagtgacagcaataagccttcacatatcaatgataaccttgaatgtaaactgattaaacttttcacttaaaagttatagactgactgaatggataaaatacataacccaactgtatgttgcctacaagaaactaatctcacctgtaaagacacatatagactgccagtaagtgatggaaaaaaatattccatgcaaatggaaaccaaaaacgggcagaagtagctatacttatatcagataaaataagctttaaataaaaaacagcaaaaaatgaaggttattatataataataaagggatcaattcaacaagaggggtaacaattttaaacatatgtgcacccaccaacagaacactcagatatgtaaagcaagtattagttttaaagggagagttagagtccagtacaataatagttgagggtttcaacaccccagtctcagcattagacaaattgtatagacagaaaatcaacagagaaacattgaatttaaactgcagtttagaccaaaaggacctttggtatttatagaatatttgaactgacagctgcagaatacacattcttctcatcagcacatggaacattctccaggatagttcatatgttaaacctcaaaacaagtctcaacaaattttttaaaaattgaaatcatgtcaagtattttcttagaccacaatgaaatcaaactagaaatcagtaatgatgaactagaaatcaataacaatggaaactcttcaaacacatggaaattaaacaacatgttcctgaatgaccactgg

SEQ ID NO: 108003 - DNA, 498 bp, Homo sapiens
tgtgcctttcccttcatgagatttaaaaattcctaacaatagcattatatctatagtttccctctatgtttttaacacttaacaaaacactagtcatatacatttaataccaacttgttgaatgactgaagatcatctctaaaaaactgaagctatctgaaagataggtttaatttataattgccacttcattttcttaagtcattgtgtcatttgtctcttaagtcaaaaccaataattaaagagctctaatttacaaactccatccctctgggttatagagttatcattctcaacaactcagctgtggtagcaatctatgaatatacatttgtcatacatcaaatatagctttattgttattgttaaattaaaaaagagaaacaggggtaaagtaagtattatatccattctaaggtctgagtaacactgggaaacacagagagagtgggtagcattatcccagaactgatatttaagaaacagtcaagaaaactg

SEQ ID NO: 108004 - DNA, 431 bp, Homo sapiens
  misc_feature (23)..(24): n is a, c, g, or t
  misc_feature (36)..(37): n is a, c, g, or t
cactggtcggtcccgtgctcagnntctgagagcggnntacagacgtgcacacatgctgactaattttgtattttagtagagacaagttttcgctatgctggcaggctgacctcgaactcctagcctcctcatatgatccatccacctcagtctcccaagtgctgggattacaggcatgagccactgcacctggcctttacatgtctttcgtgtgagtttaattcacttaaccttttagaaattctccctttctctaaaatgggtaggttagactcagtagataatttccaaagtctttgctagctcttaatgatttatatgcctacctgttattgagataaagcctttgattattttttaaaacttctggttatgttgagagaaaatatcatttgagaacttgaagaacgacaaagcattattgctcctta

SEQ ID NO: 108005 - DNA, 345 bp, Homo sapiens
cctgcccacaccagggagaggaggctcctaagctgcatttgggtcgttttgtttccaatgttggcattcaggtagcagaaaattccaccgcctgactgcggtcacctgttgtcatttgtgatgctgggtttttcctagaaatcacctcatcaaaccttttccatcttaatgtcagcccactctttcatttgagttgccatataaataaggactgtagtaagggcagatcaatgctgcgtgtcgctgctggggccagtgaattgacctcagagggtctgccattggcaccatcattcgtttggcaccataacgtacaaggagcaaaggacacgttttaaaaaaaat

SEQ ID NO: 108006 - DNA, 258 bp, Homo sapiens
caaaaatcttagaaatgtgcataccttttggcccagtaattccagttcaaggaatatgtcctaaggaaataatccaaaaagtagtaaagatgtaagtacaaagctgtttgactgcaatattgcatataataaaaaattagaatttaaatgttcatcaatatgggattggtcaaattaccttatagcatttagtgaagtgttatatagccttaagaaagatgatattgatttggatttgttgatgtggaaatagaaatt

SEQ ID NO: 108007 - DNA, 673 bp, Homo sapiens
atatctttttctttattatcaaattaatgccaggcattgaacatttcctgctttgtgtacacatagaacctgatatgctgacctttagcatttagaagaagactaatgtgaaagttaacagccaccttgtgcagtaggtgattagtgcgcatgctcagcctgatgctgaacgaatgttggatggcaatgctgttttcttgcatggctttagttgcacagctgtgcaatttttccagattattttcaatattaagagatctctaagcactccatttccttgtattaaacttctaacttttaatactgcattacttagaaagatgtcttagtgacacaaagttattctagtgactatccatgtggtaattaatttttacaccatcttttcatagctggatctcactgtggtatttattgctttacatttatttatgaaaatgttttgctggatattaaattcaagattggcagttattttgccattttaaagatggttttctgccttccaacattttcgttgtcattcaaattgtttctgttttagaggtaatgtatctttgtcttttctcttagaggtaatgtatctcacacaactttctctggatgctttgagatttttccttatatttttagtgggaaaactaaaatgtaccaactataaattaaaaaaaaa

SEQ ID NO: 108008 - DNA, 208 bp, Homo sapiens
tttatcatggcctcagggctatacacctggtctggccgtgcttatctttctgaccccacctacttcctcctccctccatttctgtccagctccaccttaccccaaactctttaccagctcgggcctctgctcttgccgttccctccgcctgaaaatgcttttccctctgacctttgaatacctactcttgtgctcaccattcatatct

SEQ ID NO: 108009 - DNA, 266 bp, Homo sapiens
tagagaaactgaagcataaatgtgggtgtatgtatttgtgttgcagagtgaatctatggggcatcatctctatactagacactatgtaagtgaggacaaatctatgtttccttggtagcatttatcaggccagtctgatttgaacgcacagacatttatgttttgggatgagcaggtagacaacaaggagatgggaagaaatatttcaggaagagttctccactggcttttactctgattattcctgccctgctcaagactgtgtg

SEQ ID NO: 108010 - DNA, 287 bp, Homo sapiens
tgacgagacgactccctccagtcttatctctcccactctaggtcccacccacccctaatcccgcaaacgtttcttttctctctcctcctccgttcttctcgcttctcttctcgaattctctgcttttctaattttctatttttaatatattccaaaataggtgtagttcttctagcaatgagctctcttgtcttcgcctccatctcccccagcagtctcagggttggcactggtcttctcttcctccacacagtaggtttctaaaaagtttttatattctggatctc

SEQ ID NO: 108011 - DNA, 315 bp, Homo sapiens
ttcctttcttcttcattggaagaggccacaagtgtctgccttttcagtttgaaccaaacctttgcttttgtattctaatagcaactctaaatgcgctcggtgtggttcagtggctcgcaggattttataccgtgagaattacacaggggctcacaaatcatcatttctgatcgcattgctttagagacaaagaaggcagggccccgagaatcatcatggatcttttataattccatcagtttcctggcagttaaaacaaattttatagccaaatggcaaggctaggcagggtgaagtgctgagggtcaccgtgct

SEQ ID NO: 108012 - DNA, 395 bp, Homo sapiens
tttgagaatgataaaccaaggggaaaagtcaggttttaagaagaatgtcatggccacgaagataacactgccgttgggcgttgccgtggttctgactgggtgaaggtttcccagtgaccatctttgtgtggaaagagcactctgctcctgatgttggggatgtcatgccacccacgtacatcactgtcctcagcattccagcactcttgcctattctctgtgcatctcttccaccctgcaagccattgcttatgtcaccctgattgatcatggtgtaacacccagctgtcctctgcacacaggatcccaagccagaagtctcaggattttcttggttgtctccatcttttttttgtttcacgcacctaataggtttccaagtgctacgagttctg

SEQ ID NO: 108013 - DNA, 1321 bp, Homo sapiens
cgagctgcagtgccgcctacaagtggtgcgctggctgcagctgtggcaaccccggatcccgtcctcccgcctcgcacccatcagcgcggaccccgggggcgacgcagtggcgaagtggggctgtgggcccagcggtggcaccaggcggagaagcaccactcaaccccatccctgggctgcagagggcccagcgcgggggactccgagcgtcgggagcctgtggaagagaagagcgcgcgggcgacagttaaacaggccctggggcagggcgcgcctcgcgctccagggagccccgccctcccgcggcacctccgcagcaaccgccgcctgcactgggcgcgcgagagctgctagggcggtttctctgcctcgggcctgttgggcagggccggctaaggtgcgcgtgctcgctggttctaacccttctgttgggcgtttctgctgagaggcgggaggcgctgagagtctgtgcggaggtccgtggacagactgctttgctcgttgttgctcttcggaggcggcgatccccgaaggcgagctgaaatacggctgcaggctacaatttgcagccgacgattatggaagacggcaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggtatatagtagctgactctttgagcatgagatggatttggttgaagtacataggataaaatgaatttatctcattggaataccaccatataactagtaggaaatcctacggagtgtttattttgatttttcagtatttgcatgtttctcggtctaatactgacaggctgtacaactgaggcaggaggcttgtgcaactcttctggtgaaatggggcatcaatattaggattctggaggatggttgactaggtgtttatgagattatctgttgaaaatttttcctggcaatttggatgggcggtttggtgccctgttttaattggaggtttttatggccggagggatatgggaacacctggaataggggggggaaatagggaaagagtttggaaaaaaaataggggaggattggtggaaaaggtaggcgtgg

SEQ ID NO: 108014 - DNA, 1169 bp, Homo sapiens
cgagctgcagtgccgcctacaagtggtgcgctggctgcagctgtggcaaccccggatcccgtcctcccgcctcgcacccatcagcgcggaccccgggggcgacgcagtggcgaagtggggctgtgggcccagcggtggcaccaggcggagaagcaccactcaaccccatccctgggctgcagagggcccagcgcgggggactccgagcgtcgggagcctgtggaagagaagagcgcgcgggcgacagttaaacaggccctggggcagggcgcgcctcgcgctccagggagccccgccctcccgcggcacctccgcagcaaccgccgcctgcactgggcgcgcgagagctgctagggcggtttctctgcctcgggcctgttgggcagggccggctaaggtgcgcgtgctcgctggttctaacccttctgttgggcgtttctgctgagaggcgggaggcgctgagagtctgtgcggaggtccgtggacagactgctttgctcgttgttgctcttcggaggcggcgatccccgaaggcgagctgaaatacggctgcaggctacaatttgcagccgacgattatggaagacggcaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccaatccaaatattacggatttctttggaaggactgctctgcactacgctgtgtataatgaagatacatccatgatagaaaaacttctttcacatggtacaaatattgaagaatgcagcaagtgtcttctcagaaacaaccagccttgaaggctacaagtggcaaggaagattctatttcaaatatagccacagaaataaaggatggacaaaaatctgggacaggta

SEQ ID NO: 108015 - DNA, 1263 bp, Homo sapiens
cgagctgcagtgccgcctacaagtggtgcgctggctgcagctgtggcaaccccggatcccgtcctcccgcctcgcacccatcagcgcggaccccgggggcgacgcagtggcgaagtggggctgtgggcccagcggtggcaccaggcggagaagcaccactcaaccccatccctgggctgcagagggcccagcgcgggggactccgagcgtcgggagcctgtggaagagaagagcgcgcgggcgacagttaaacaggccctggggcagggcgcgcctcgcgctccagggagccccgccctcccgcggcacctccgcagcaaccgccgcctgcactgggcgcgcgagagctgctagggcggtttctctgcctcgggcctgttgggcagggccggctaaggtgcgcgtgctcgctggttctaacccttctgttgggcgtttctgctgagaggcgggaggcgctgagagtctgtgcggaggtccgtggacagactgctttgctcgttgttgctcttcggaggcggcgatccccgaaggcgagctgaaatacggctgcaggctacaatttgcagccgacgattatggaagacggcaagcgggagaggtggcccaccctcatggagcgcttgtgctcggatggcttcgcatttccccaataccccattaaaccgtatcatctgaagaggatccacagagctgtcttacatggtaatctagagaaactgaagtaccttctgctcacgtattatgacgccaataagagagacaggaaggaaaggaccgccctacatttggcctgtgccactggccaaccggaaatggtacatctcctggtgtccagaagatgtgagcttaacctctgcgaccgtgaagacaggacacctctgatcaaggctgtacaactgaggcaggaggcttgtgcaactcttctgctgcaaaatggcgccaatccaaatattacggatttctttggaaggactgctctgcactacgctgtgtataatgaagatacatccatgatagaaaaacttctttcacatggtacaaatattgaagaatgcagcaagatcagccctcatacatgctgttactcttggagaaaaagatatagtcattcttcttctgcagcacaatattgatgtgctttctcgagatgcgtttcgaaagattgcaggagattatgccattgaggctaagaatagagtcatttttgatctaatttatgaatacgaaagaaagagatatgaagatcttcctataaatagc

SEQ ID NO: 108016 - DNA, 775 bp, Homo sapiens
tatttgcttttcttcatgaagtgaaatgactagtgatttgggcccaaaccagaatctttttagctcttgctctttctctgccattttgtgtgtgcagttgtgtaactctgctgcaagccatagccaggtgtctgtgatcactgcctcatccccctaccccactgaaaggaacagcagctgatgagaaggcggcaagcctgtggggctcaggaacagcgcaccagcagaaacggaaactgtagcaagctgctccttgaactgcgtcataaagagatttgtctttatcagtcattcgtggctattcatatattcagatactgaattatccatgccgttgagggggtcaggaatggaaaagatattcaaaatccacaggcaatccaaagctttatttgcaccaacagctttagcttctaacttgttctcttccagtttcccggaacttctattaagaatagaagtgaatggatgggtttgatcagggtaaagagtcaaatgtccaaatgatgggaaggaacaaaggaaggacagtaaatgattggtaacaccaacaggctgattcattcctgaaagatccagaggtaaccatgtcattattttttaaaggcaaagagaaatattgttatacactgggacttgaaactagtatttttggccagacatggtaattcatgcctgtatttccagtactttggaaggccaaggtgggagaatcacttgaggccaggagtttgagaccagcctggacaacatagcaaagcctgtctctgttaaa

SEQ ID NO: 108017 - DNA, 177 bp, Homo sapiens
aaagggacataatggattaggctgaattaccaagtatttaatacaaaaggattaattgggtaggctaaatgtagacacatttctgtcatttcaaacaggtgtagtgaccttcactcacatccttagtgaatatattatacatatttgtatggcttcagattcaagtctcttcttcca

SEQ ID NO: 108018 - DNA, 636 bp, Homo sapiens
tgagacagtcttgctctgttgcccaggctggagtacagtgcagtgatcttggctcaccgcagcctctgcctcctgggttcaagtgattctcgtgcctcagcctcctgagtagccgggattacaggtgcatgcccctacacctggcaaatttttgcatttttagtaaagataggggtttcgccatgttggccaggctggtcttgaactcctggccttaagtgatccacctgccttggtctcccaaagtgctgggattacaggcatgagccaccatgtccggctatgcaaagaatttaatttaaacaaagctccctgagtaagtagtagtagcttggtctgagacagggagtctggtaaggagcctgggaactcgggaactcaagttctcttttccctcttttcttttagaaggcaaaagttcagaggcttaagatgaattttcagccactcactaataaaacaaatactactggaccctattattcaccactggtgaacaacacagatgtcagggatcctgtggtgtttacattttagtgcaagcagacagacacttttatatagaaaaatatcagatagtgggaagcactagaaaaaaattaaaataaagtaacttgacaggagtgactgggtagc

SEQ ID NO: 108019 - DNA, 322 bp, Homo sapiens
agttaaggacccagaataggtttgaaaatggaggtagatgaagatgttaagcatggtccccttgcgagggctctgcttccaaaaatggagggcttattcttgaaagtggagaatgaagaaccaggcaaagggtccggccctggctttcccacacccatcccctcacaatggggagccatgggcttgtgagagacctgcttgcctgaaggaaggggcaaaagagaactgttgattacatcgttactgatgtactgggttcatctgtgctcagcgctgggccgattgagatgaacacacagtgcctggcctccagcagctttca

SEQ ID NO: 108020 - DNA, 571 bp, Homo sapiens
gttgtttagttgatttttatcaactaaaactgggagttttagctgacccaggagagtgaaagggctctctttgagactgataatcattttctgacatgaggctatttaaggactcaagaacttctaatgtcaattaaccatgaaatattttaatagtgcttagtctttgctcaataggttggtctgtgctatgtttgtaatagatgtaagtcaaatcgacattttggtttatgagattccatgtttcagaagaggctattggattcttaaagtgtttattcagtcatcaaatatttattaagtattgaactcatgttaggcattgtgacagacatggggtatttagtggtgaacaaaatatatattttcctgctgtcatattctttgaaatctagtgaggttggcagactttaaaaagacagtaacacaaatgaatatactgtcatacattttgataatatttgtcattgcacatattgatttcattgaacactagagatgtacttttttagacatatcttgaaaagctgtgtgtgtgtgtgtgtgcatgtgtgtatgtataaaaattcac

SEQ ID NO: 108021 - DNA, 348 bp, Homo sapiens
ggtgggaacattttaagactaagaaattgagtggaagaaaaattaatagacgtgtctttgaaggtaggaattccgtccttaaacttacatccctgatgcctgtgcggaataagtgatattgaaagaatgcatggagttctttttttttttttttgagacagcgtctcgctctgtcacccaggttggagtgcagtgacgcaatctcagctcactgcaacctccacatcctgggttcaagtgattctactgcctcggcctcctgagttgctgggattataggcatgtgccaccatgcccagctaatttttgtattttagtagagatggggtttcgccatcctgacctcag

SEQ ID NO: 108022 - DNA, 335 bp, Homo sapiens
atatacctgatcatacttcacttaggaatataggaagtgaaaactcacaaaacacacattcagaagctgtcctttaccctcaaaattactaggaagtcaggtttaaatttaaaacatgtatgctttttgacttgagcattccacttccagaagtccatcctacagaaatccgacaaatgggcagaaaacccctataaacacatgtactgctatattatttaaagagaagaaaatgttggatatatctgagtgtctataaataggggaagagttaaataaagagaaaaaagaaaataacaacaatacctatggtataatcataattatactgaaca

SEQ ID NO: 108023 - DNA, 741 bp, Homo sapiens
actaccttttattttattttatttttttgtttttctgcttataaaatactatgtactaattgagaaaaacttggaaagtagaaaaaaaatatatatatatatataaattaattcccttgtcattcctgtgtctagaatagttaataacatcattctgatggatttaccttttatttatgttttcctgtatgtatgtgagaactcaggcacttaattgggcttaagctgtatatgttccataccctgctattgttgcttgacattttattatggatattttcctccatgtcattaaatattcttcaaaaagataaacttaatggtcatagtaacccaacatttttggatacaccatcccacttgccaccccccagctctttacactaatattgctttagtcttttttttttccatcctagttaaaagctgagatgaaaatttgtaagtagagatggctgagcacttctccattttccttcaatggctcttaaaagtaaaataattggctccaggtatagacaatattaaggattgaaattgtctgtattgacttctttatcaagaatcaggtagttttggccgggcccagtagctcctgcctgtaattccagcactttgggaggtctaggcaggctgaatcacctgaggtcaggcattccagactaccctggccaacatggcaaaaccccatctctagtaaaaatacaaaaaaaattagtcaggcttgatgacaggtgtctg

SEQ ID NO: 108024 - DNA, 424 bp, Homo sapiens
tggatggctgctcgggagcagccactagggaagccccacacagtagccagattgtgcacattttcaagagaagctggaaattgttgatggtttctaaatgtcagccccgaagtcaatattggaaaataaaaccccggtagacagctggttagctttctctagggtaaatcacagtgagagaaacagctgagcagggaaggatcaagctccagagaacagagtcagggggctctgccattcattgactgcgtaccttcaagcaagtagatcaaacactctgtgtctccgtaaaacagggaggataatggcacctcattggggtggcatgatgattaaacgcaataatgcatggagaatgctctaggaagcaccctgcatgtgggaagcaatgaataaatgcccctctcagtacaggttgactggg

SEQ ID NO: 108025 - DNA, 430 bp, Homo sapiens
tgagacagtctctctgttggctaggctggagcgcagtggtgcgagatcggcccaccataacctccacctcctgggagtttcgccatgttggccaggctggtctcgaactcctgacctcaggtcagatctgcctgccttggcctctgaaagtggtgggattacaggagtgagccaccatgcctggactcatttcattttttagacatccctgagaggggtgttgcagagtgctgttcctgtatggggccaggcagttgcagggttggattctgactctgctgtttattagccttgggtatgaacacttctctgctcctcagttttctctaatgttaattaactagtcaatcaatctaccctacagatctgtaaagaggttgacagcaaatacatactaggtacctggtacacagcaagtaccccataggca

SEQ ID NO: 108026 - DNA, 341 bp, Homo sapiens
tgatgcccaggctggagtgctgtggcatcatcatagcttaccccaaactcttgtgctcaagagatcctcccacctcagccttccaaagagtccagtttattgagaaaaatattcgagttaaaagtatccctaaagataataaagctcagaatgttctttctacagacaaatagactcaggaccatacagtgtaagtaacttggttaagatgatacagctgttacatggtagagttagcaaacaaaaacaaaaataaaaacctctccggccagcagcgctcaacatgactagcacccacctccagccagggacctcacggtttctcatgcccatctggcaca

SEQ ID NO: 108027 - DNA, 544 bp, Homo sapiens
gctggagaatacttttaattttaaaactcaaatggagtggtgttttgatggaaactaatccatgatttagggtaaatggagttattgtgcatgaccatgtggaatatgttatcaatatgagtcaatcagaatcactaaggtggtattaaactgcttatatgtcttgtttataattagttgtgttattgtctttgttacttgacttccatattacttaactgttgatgtggttaatcagaacatgagctttttgagggtgaattctatgcccatatctctcaaaggcctaaataggaatgtttgcacacaatacttaaaatagtttttccactaataaagatttctgatacagattcaacatactgtaaaactgatttcaaccgggtgcagtggctcatgcctgtaattctagcactttgggaggccagggcgggcagagtgctttgagctcaggagttcaaggccagcccggacaacatggagaaaccccatctgtacaaaaagtacaaaaaaatgagtcaggtatggtggcttgtgcctgtgt

SEQ ID NO: 108028 - DNA, 159 bp, Homo sapiens
ctggtttttatcaggattaatcacttttgtgcttccaaaaacaccagcaagaaagtgaaacacagctgggtgcagtcgcccacgcctgtaatcccaacactttgggaagccaaggtagaattgcttaagcccaggaattcaaagccagcctgggaaaaa

SEQ ID NO: 108029 - DNA, 646 bp, Homo sapiens
ttagttttgactccttgatacttccatttgccagaatgtggcatattgcaaagttgtagtcagtaattatttgtaccaccatatttttctgcgtacaacaaaaaaaatctcatattacttatcacagtctgcagttactacttaatcgaaatagcaagggaatctaagactcaaaaataagttcttaatcaaaagtgttaagtaggaagtttgggagaaaagtaatttgtacctattaatatttgcattgaaaatttaagagttgataaggcacctgcaacgtcacaaatgtgcacaaattattatggcaaaatctctcttaagatacaagttgagtaacatgtaaaggccatttattatccgaaaattccctattggtaataaataagattttaatataaaattttctttgtatagacttatcccaatgaatggagcagctttatacatttgtcaccatttctaccttagtaggaagctattgaaaagtgatcactactgcctttcattagcccctagtattccataacattctcccagtggctctcggtgtgggcaagaggatggcaaggagggagtgatgttctaacaggcaagcaggaaatatttctcttctagccttacctcaaccaaggaagctcctttg

SEQ ID NO: 108030 - DNA, 518 bp, Homo sapiens
taaccaggtttacgcgattctcctgtctcgttctcccaagtacctgggactacaggcatgagtcaccacacctggccaatttttgtatttttagtacgcgatggggtttcgcctatactggccaggctggtctcaaactcctgacctcaagtaatccatccaccttggcctcccaaagtgctgggattacaggcatgagccactggtatcccgccttatcaccattttttcatttcccttctttccctaccatcatccaaatgtcagctccagaacagggaccatgtttgttctgttcactgctttatctctagagccttagaattctgcctgccagagtaggagctcaaaactttgtttttgtgactgacaacctctgatccctggtccctctccaatttgtccctctccatcaggcaggcccctcccgtcttcgaagctcccatcatcgccccacccctcctcttgccaatatcctgagttcctttgcctttaatcaaacctgttggaagacgctc

SEQ ID NO: 108031 - DNA, 259 bp, Homo sapiens
tcctccctcccaccctcactctcttctccccattccccttcccttggggctttcgctccctcccaccacgatcctggctcccaccctgcctcttggaagtgccctcctcacaccacacaccaactcatcttcctgaagtcactcagttcaaacaacccaattagaacccgggcaaaggatccgagaaagcattcctccaaagaaagacaaatatctgataggcacatgcaaggatgtcctcatgagccgtctgggagag

SEQ ID NO: 108032 - DNA, 561 bp, Homo sapiens
tgtttatgcctccagaactttttacgacgtatccttgaataaagattagttaaaaaccttttgtacctcctccaaagagtggctataagacaagggcaggccttggagctcagattattaagtattaaactctcttggatgattaaggtttatatctcagtatgacagggacaaagctgataaaaggaccaaatttctctgggtaagctctgtgaatgtagttttagagtatacaagaattatcaatgattatgctttcaggtgacaaaactaaatccaagtctcattcttaaaagcctattgggctgatgaaaactacaacatttgtcattattggatgtattgtgttccagagttccttcctaatttaggacagttacagagaaagggcttcatactgtaatctggtgtgactaccattgacatactcattatacaagccaatcatggaacagctatttgcttttatgctatgaagcctaaagactgagcctgaaagcttttaaaagtctacctacaaggctgggcacagtggctcatgcctgtaatcccagcacttca

SEQ ID NO: 108033 - DNA, 419 bp, Homo sapiens
tttacgaggcctaagaactgccagcttgtgggaggaaggaggaagggggaagctaaaacagaaagaaatttggagaaagttggttgacttatagttggatgctaagattctcttccccactctatcatgctattggttactgttgtttccccactacagaagtctagaggcttactctctacagtgggtaaaacgaatctttgttttaggggagaccaggcacaggggagagagtaggcactatgccaaaaccaagaggattaaacgaccatatacatgagacacaaaccctcacctcatatcccctttttttctgcttctaagttggctcctaggcgacagcaatgctccttaaactatggtctgctgatggcccataagccatctatcaccagtccatgacaaggtaagtaccaaaa

SEQ ID NO: 108034 - DNA, 310 bp, Homo sapiens
tgcttttctgttcagtctgttacaatatgctgtttgggttgaagtatatgaagaaaatctggcctcatgcagatatgtagttgcaaaaggaaatactttatagaccacaagaaaggatattgaggaccctgaagggtctttataccacacctttgagaaccacagttttagcaaaccaaccatgcaaagtgcagtcctcagaccaacagaatcagcatctcagggtgcttgtatttagtgtaaaattttggccccattccaggcctgttaaaatctgcattttacatagtccaagggtgattcatatgta

SEQ ID NO: 108035 - DNA, 1700 bp, Homo sapiens
catgcgtaacggagttccctttgcggggcgccgggagtcgtagttcttatctttcgggcccgccgccctcgcgcgccgtgcgacgtagccaatcccaggacgcgtagggggcgtctccctggccgccaccttccatcgcttagacctcgctaaagaaacgcgagcggccattggtgaaaaatcacacgactcgctgaggaaggacggccaatcgcagagaagatggggcgggttctggaccgtaccattctgtttcaggaatacgagaagattcgatggcctatgagagtcctcacagaatatttttatgaaaaggtgcgttataaaggctattatcgtattttgttctcagcggaggggttccgaaggttatgaacctttattaactaacgcaagaatggtttattcctaaaaagtagtccctaaaatgtaaaagaattaaatcctataaagagagacgtcggcccacggctgctaactcgcgagtcttaagattatagaaatggcttcaaggcgggtggtgagtgcctgagactgacacttgcggaaggatatcgcgagcacattttgtaaagaccgaagagcgcatgaagaagtaaacaaatgaagaataaaaagtgccgccttaaagggacagtgtgactgcgtttagcgccgcaggtcgcactaggcctcggaagacgaagaggcgggttcgagtcccggtgacgcgactcccggactgacctcggtacccttagctgaaggtggcggagtcccagccccagcctggtctcagaaagccgcccccgccccaggggcaaatgcaaactggtgattcgcgaccaaggctcttccctgggccgagatcggaaagccggggccgggggcgggcgggggagtggagggggaagcgggggaaggccacgcccccacgcctcagcttctgtcgaagaaaatggcctcctggggccgatttggtcttttcacttccgaccgagatcatttcctgagccgggacagaggaggtccgggacagccatgaggctgtttgttgggaagagttcggaatgattaatgagttgaaatcatcagccctggctatccgagagggaagcaggtctcacccgcagaggcccttcctcatcagtgggcgctgggcaagactgggagggaagcatggaggaggccttgctccgaaacttgctgcaggggattctggcgcagggctgggggggccgattcccccgggggcgtagtttctcagagagaaattctctagacccaagcccccagccctccataaacagggactgagaggacccagagaaccctccataccagtcactgaggcctaaaatcttggcgccctttccacttctccttcgccacacacccagtgaccctttcttcttattgcttccttaatagcatccctgacattccagcacgtttgcactgtgtaccttttacgcacagagccatgtgacctcaccacagcctggcaagttagacacgataggaatgagtgtctccattttacagataaggcatctctaagacactggaaaataagtgacttgtccaaggtcacatgacaaccatggggcagttctggctagagcgctggtctttgtgaccccccccgtgccatttttctttctgtcacaaacacaaaacccattttttcttaaaatcggggaatactctgaaaaaaaaaa

SEQ ID NO: 108036 - DNA, 331 bp, Homo sapiens
gcgctccagcctgggtgacagagcgagactccgtctcaaaaaaaaataaataaaaataaaaaaataaaaaataaaaaaaaaaagaaatgatggtattagtaatgtaaagaaaaaataacaggccttctacaaatttgaagtagaggtactgaatttgatacatttctgtaagcatttttctttttttaaaaaaataatgacagagtctcactatgttggccaggttggtcttgaactcttggccctgaagcagtcctcctgcctcagcctctcaaagtgttgggattataggcatgagctgccgcactggtcctctgtaagcattttttaa

SEQ ID NO: 108037 - DNA, 1064 bp, Homo sapiens
ggctcagatttacctgaaatttaccgcagattctaagtttccgctatgaatttacattttgtgagatactagttgaactcagttaaagagagatttaagtaagagttgaagatgtcctgctctctgttctttcttggtatctaatttcttttaggtgtagcagtacaaagtcaacaatgttgaggtgtctgccttttctgcttttaaaagcttgattgattctcctataagaggtccccacccccttccctccaaggacaagctaatgcacagaataatttgtgaaaaatctacctggatttcagtctaagaaattattgctcttcacagtctctccctctgatttttagaaaactgatggataatcatttgcttgagcgtgacactcagctatttgagaataacattgagatggttaaatttaaattaaacatgatatgagacgccctctagtcctccttccccagttcttctgcttcacccatgaaggcttctttgtgaagctctggaaacttctggtaagcaggttttatccccgcagatctttgagctccagtaattagtcttagattccctaggtaacttgcatggtaattactgcattagctttcttgaatagttttctaacttaaagaactgtattcatttctgtagccaattacagaaaactaataggtacacagtaacagtccttaatttctattttactttcttcccgcccccaaccccgaaatacacacactattattttgtttcttagtttcttttggagccactaataccatttgatttttatagacatcgtcaggtttcaaagagatgagctggaatccaagatgactgaatattatcaatcacatatttactgaaaacttagtggcaggaaacagtgctattatgtcaacccacacatttatgactcatgcaaatgagatacctttcaaatgacttgtaaaacaggtatttcgtgcctgattactttgttacagataactattacactgtggcaattttattaaatcttgtattatcccctcaggtttgattaaaatttcttggaagtt

SEQ ID NO: 108038 - DNA, 351 bp, Homo sapiens
gcgcggtctgggacgcactaaacctcttttattttataggggatagtgatggtattccactattaaaggccaccatccccaaaaatcagtatcgttcttttatgtctcaaggcagccctgagttactgataacaataagcatgaattatgttgtttaataagttaacacgaagattctgcctggcagatgataattaatagcctgacaatgtaaatacagacagaatcttcgtgttaacttattaaacagcatttttccgtgcttttgacatcagtgacagctcatggttaggtttttgtttagttttgttttgagacggagtcttgctctgtcacccaagctggagtaca

SEQ ID NO: 108039 - DNA, 149 bp, Homo sapiens
ctgaactcctgacctcaagtgatccccccgcctcggcctcccacagtgctgggatgacaggcgtgagccaccgcgcctggctcctttcccattttctaagggacagtcagtctcctccataccatttgtcacacagcctttcccccatg

SEQ ID NO: 108040 - DNA, 545 bp, Homo sapiens
cgccactgcactccagcctctgggtgacagagggagactccgtctcaaaaaaaacaaaaaaaaacaaaaaaaaaacttgaagttattttatgtttaattaagaaatccttgttttttcatgggaaataaaagttactaagagctactaataattactatatgtaattaaagctaccaaatataagaaactgttctacatacacagtgtctaaagaaagtaagatgtgtttttggtgaaatttaattttaaaaaaacatgaggatgtggtttttgctgaaggaaaagtaattttgtctagttgagaagctatttaaaggttgcctcaaaataaaggggaaaataatataaataaaactaaatggctagaaagagaaaagataaaagtgtggggaattaggaacctttgattcctgggtggccaggtggtcacccatggtatggagctgcagctgggctgcattcagttacgaaagataaagggcaccagaaaaatttagagatgggtccaactcctggggagttggttcactggatgcataaggaa

SEQ ID NO: 108041 - DNA, 412 bp, Homo sapiens
gaaggtgggagatggcacatgggaaagagcagagaccaatttacctgcttccaactccggctaaaccctgtccttacagagtgccttttgcccagaatattcttcagacaccatttagaaaccaagatggagggtgggggaactggtttacagtgccaagcacattcactgcctgccagatcatctcaggtaggcatggatttgggttctgtctagggccttatagatccaggacccgaacgattcttgcaggtctccagttgccccaggcagaaacaatgaaggcatctagatcacgactcctccatcaccaagacctgccggataccatgtcctatgtccccccccacaattccttcccctcacctcttacccagatctcaacggtggcctccttgcatgccatcctgtc

SEQ ID NO: 108042 - DNA, 643 bp, Homo sapiens
agtgacaaacctcttttggtttacaggcggtcagacactcagcatgactggcaaaacagattatctgtgtgtcagtgtacattttattcatccgtcgtttgggtcagggtctgcgggcagacacaggtagctactgccctgttgtgagaagcaatacctcaattggtgccccatgtgaggagagctgtgtgaggacagtcaggggtctgcagaaacagaccttccgcagttggagccccttgtaaggcaagctatgaaggaagtgtaaggaccgctttcatgaggaaagctgcaaaggaagcctgaggaatgcgacgggcccccaggaaacaaaggtgaagaaaaaccgcgtggtcaagtcagtgagtaactacaatcaaagacagccttgcagagccccaggggagtcaaggggaggagcaggctggcaaggagagagatgccccaggtctgaaggagtgatgtagaagacaggatctgttggctgggaacctaaggatgattcacactcacttcctagaactgaatcaaaaggaaaatcccacctctccacaatcaagtaacaaaaggatcagaggctactccttttgcaaatcatgccaccaattcccactttccactgcattgcagatgaaaaacggaa

SEQ ID NO: 108043 - DNA, 473 bp, Homo sapiens
acaagctgtgtatcctgtgagtatgaaatttacttgagatcagtctagacccaccagaggaactgaggcatcttttggggaactggaagtactgtacacttcttagctatttttgtgtgtgagagagttctgggtatatgtgcacacatttgtgaggattaaaagtagaaagaaacagctataacacccccgaaaacgatgacagcactgaattgagaagaattgccactttgcgtgatagaggcaggctgaccacacttaagctctactctgtcacctttgataaggcattaaagccaccccaaatataaagtgaacatgtacatttcagatgcagcagacaagttgcaagtggaaatgctcagatttctaactatataaacagagaagctccgaggagaagcgatcagtaccctccacattcaaattctgacatattttataatttcccagcagctcagggaccctctgtg

SEQ ID NO: 108044 - DNA, 464 bp, Homo sapiens
ctgccctctcccatcaccccggaccctgtgatctccatgccaccctcacctgccctcccctctgctctccctcctgccaccccgcatcgcggagaagctctcctgaaattaattagtgtggcgtgtttacggtctctctcgcctccatcccgtcagaccccactcttggaacagagggcatggaagacagctttgccacttgttagctgtatcatcttgagaaaggacttctcttctctgagcctcagtttccccttattgaaaacaccgataatagttgcacttatttcctagcatactttgtgaggcttcagtgagacaatttatatcaatcatttcacacaggaatgaatcataaatcataggatcatagatggtgtcattatttgtattctgtcatgtctgaagacagctcattttaaagaagatttgctggtgatggctgttaggggaacatctcgtta

SEQ ID NO: 108045 - DNA, 451 bp, Homo sapiens
acagccacacaactaggatgaagcagagctaaaactcagctctcattcactgccaagcctgtggtcttagagacataagccagcaggacttggtgtcattaagggactggggagagtggttccattcccccaaatcctcccccagagaacttcctcgtattttataatggtcataccttcaacccttttacctcctacctgggctgattgcaataatctgaaagggccctgtttgaggggcaatggtagttactgtggagaagggcttcaaagaatatggatggtggtgccaatttacctcccggactgtggctgctgctgtgtgatgttggggtaatggttaatctgctcttgtgtgagtcagctaatgcccctcccaaatcacataatgcgttaactcagttaaaagacacctgcccaactcatctgaatgtcagacctgagtgtcagc

SEQ ID NO: 108046 - DNA, 440 bp, Homo sapiens
gagaatgagattatggttacatgtaactacatgggcatttcatttttaaagcctctttgaactttttgaaatactaagaatataaaatttttattttttaagtttagatgtcctgaacgagtatgtttaggcaaaattgagttatttaagaatttataggctgggcgcagtggctcacgcctgtaatcccagcactttgggaggccaaggctggcggatcatgaggtcaggagatcgagaccagcctggccaacatggtgaaaccccatctctactaaaaatccaaaaaattggccgggtgtggtggcatgtgcctgtagtcccggctacttcggaggctgaggcaacagaattgcttgaacccgggaggcagaggttgcagtgagccgagatcgcgccactacactctagcctgagcgacagagtgagactccatctcc

SEQ ID NO: 108047 - DNA, 674 bp, Homo sapiens
gagaatgtcaaagaacttctcagaatcacattaagcatgctaattaccaaatattaaatgctaattgttccacacgcagttcgaatgccaaggaaggaagatgaaactagtataagctactcttgacattatgtcagggatggttttgacacgttttgcagcctccacctggaggtggggaacgtttcctgtgtcgtccccagagcagagtaacagcgttgtttatgggtgagagcaagcctcaagcctaggcaacaatgtgccttgcttgcttttaagctccttctaaaggggaggtaaaccaagaccgctaaagaattgctaggtgcctgggcgtgatggttcaccccggtaatcccagcactgtgggaggcggaggcggaggcgggcggatcacgaggtcaagagatcaagacgatcctggccaacatggtgaaaccccgtctgtactaaaaatacaaaaattagctgggcatggtagtgcgcgcctgcagtcccagctactcgggaggctgaggcaggagaatcgcttgaacccgggagttggaggttgcagtgagctgagattgcgccactgcactctagcctgggcaacgatagtgaaactccgtctcaaaaaaaaaaaaaaaaaattgctaggcagctgggcacaggggctcaggctgataatacta

SEQ ID NO: 108048 - DNA, 271 bp, Homo sapiens
cccaaagtacacatttaggtaaacattcctctgtatgaggataaggggaacccagataagatattaagagagataaaatgaagtctgaaattcagtgcaaaacaaagatgtacagatctagcatttaactttttaaatactgctaaaaattatatgataaagctgttctataaataatctaatatttatgctattaatgattatactttttctagccgggcatgggggcatacgtccatagtcccagctactagggaggctgagccaggag

SEQ ID NO: 108049 - DNA, 356 bp, Homo sapiens
tgtttctataagcctttgcactagcccatggatgcatggtatgacacaacacccaacaagaatgagtacaccaattactgctgtaagagaagtaagaattgaggctacaatttctttccatttactgaaccacctttctagccatcttgagaaagggttattgactccagaatttttagctaattcattggataaagtggtaaatccttgtagggcccttgttatgctcccattgggggcagtgttgtttgcccccaatggataaaggtacaacactgagttttaatcataacacaaacaccaccattttcagctaatatcataactagggccattctgttttcccaggccatctg

SEQ ID NO: 108050 - DNA, 281 bp, Homo sapiens
aggaataacaagggcaattccacgagtcttatacaaataaacctaattagctaatagtcatacctagcactgcctatgttatttactaattattccgtgtatattagtcgtggttctccaagaagactctttaagagcaaaaaccatgtttttttttactctatttgtatttgatagcatcttgtatagtagtctgtttttgataggcaccagtattatttcccaaagtaggaatcatttatctatttcactaatattttctgaactcttactatgtgccg

SEQ ID NO: 108051 - DNA, 319 bp, Homo sapiens
ccattttttctttttcttttgagtttaacttgcccttctttttcttgtttcttaagttacatatgaagtcatttacttgaaaaattttatttggtttcagtattggagtattttccagatattttttctgtattgatttctaatttaattgcattacggtcagggagtattcatgtatgacttgaatacaagtaagtttattaagagtcgttttatggcacagattatggtccctcttagtaaatgttttgtgtacacttgaaaataatgtgcattttgctattgttggatgaaatgttctataaatgtcaattgtgtt

SEQ ID NO: 108052 - DNA, 450 bp, Homo sapiens
gaaagccattaatggctctttgatttctaaattgcagccttgaggctggactgctcccatcacaggccttggaggcagaagactgggaggtttggcttgatttaacaattctttcagtggatgttgaaaggataacatctacctgggcagtcaatttatgaccaagcttggcgaggtggctcatgcctgtaatcccagcactttagaacgctgaggtgggaggattgcctgaggccaggtggtcaagaccaacctgggcaacatagtgacaccccatctctacaaaaaattagaaattagccgggcatggtggcaggcacctgtagtccgagctactcagggtggagtgctgggctcaagtaggaggattgattgagcccagaagattgcagtgagctgtgattgtgccactgtactgcagcctgggtgacagagtggagaccctgtttc

SEQ ID NO: 108053 - DNA, 451 bp, Homo sapiens
cgggaggtggaggttgcagtgagccaagatcacggcactgcactccagcctgggtgacagaacgagactccatctaaaaaaaaaagaaaaaagaaaggagtacttgtgcccttctggcttcagctttgggccgtatctggacagcaggaagggccacataaccttctgtgactgtagtcgtctgtccagtactttctctgtgccacacacctgcactacagtaaccccgaggtagagtgccagtatcttcccttttcagataaggaagctgaccttgagagaggtttagtaactcacccaaggccatagttctaagcagcccaaaaagtatgcaaactcggtatcaccttaaagcagggaaagttgcagggataagagtgtagggcagagaaactatagccaaatgataactcggataataaaagtctacttggtttgtacgttctccgca

SEQ ID NO: 108054 - DNA, 423 bp, Homo sapiens
aggccaggagttcgagttcaagactagcctggtcaacacagtgagaacccgtctctgcaaaagcttcaaataaaaaaaaattagccaggctcagcagtatacctatagtcctagctacttggaaggctaaggcaagaagctcacttgagcttagggcttcaaggttgcagtgagctatgaccatgccattgcactccaacctgggtgacagagcaagacctcatctccaaataaataaagtattaaaattaaaattaaacctaccccaaattttgaggggtgaggaatatgtttatggccttgatggtagttatggtttcagtgatctatagttatctccaaagtaatcaagttgtatatattaaatatatacagctttttgttcaattatactctgataaagtgattttttaaataaaatta

SEQ ID NO: 108055 - DNA, 313 bp, Homo sapiens
aacagacaaaaccatagtttccatcagaattaggcagcttggagctttgccgattaggactagggcagccctaagcaccaggagaacccgggctagagtgtctctagcctatcaccaagttctcccagctacactcacaacggtcccagggaagcaggcggggatctcttggggaagaaggtgcttcctaaagggaggggctcactgacggagggatttaggacatgggagagaccaggtccacctctgagtaactcttcactctgctggattccaagagaaatgtctggccatgcacaaatgaagtcctgtg

SEQ ID NO: 108056 - DNA, 354 bp, Homo sapiens
atagagaacccagaattaaagccacatatttacagccaagtgatctttgacaaagttaacgagagcatacaatggggaaaagacatccttttcaataaatggtactgggaaaattggattgccctgtgtagaagaatgaaactggactgctatctctcaccatacacaaaatcaactcaagctggattaaagacttaaacctgaaactataaaaatactagaagaaaacctagggaaactcttttggatgttggtctaggcaaataatttattgttgaattctcagaagtacagacaacaaaaacaaaattggacaagtgggacttaaagaacttctgcacagcaaaagaaata

SEQ ID NO: 108057 - DNA, 291 bp, Homo sapiens
ggcagcagcctcagaaaagagatgggagggtccctagagttccctgggaacagcctccctgtttgccttcctttttcctgataatctgagtcagtttgggccttttatgttcaaggctgtccactgggcaccactccccagtcccgtgatcccacccaagagcaggaatcagttcttcctctccaagcgatttctgtgtgagtcaggacagtagtatgtcatcagggctggccaacaaagcaggggtaaggtctccctggaactagaggcatgtgcaggggctgcaaaact

SEQ ID NO: 108058 - DNA, 363 bp, Homo sapiens
tccttataattatctagttaatccagatctcaccattttataaacgaagaaactgagatagtttgtgagaaatttgcccatgttcctatatagttaatggcagaaccagaaacttgagttcctgatgcctacagtactgcagtcttctagtgtaatagacagttacagtgcataagcagcattttttcatattttgtgggctattcagttttgtcttctttgattgcctctttaaaagttggtttagccgagtgctgtggctcacacctgtaatcccagctactcaggaggctgaggtgaggggattgcttgaggccaggagtttgagattagcctgggcaatataatgagaccttgcctctt

SEQ ID NO: 108059 - DNA, 513 bp, Homo sapiens
tgctttccaaaagtcattttgaaccaaggctgatgatcattggtttgttttgcacaagagcgcgtactttgctagcagagtgagagtgagagtttgggcaggaggcagccaggcatgaagatgtaggaggcgtcctgccctcggccacgtgcggggatcagagttgggtgaaccctgcttaggagtcgttagaacacaatcctgagacagtttctcctccgaggtggttctgctgggtttctccatctcaactgctgttgtcctgggttacagttacaggcgcttgtgtgaattgcggtgttttaaagccttcagagcagaaggatgtgaacttgtccttctccttgtgcccctctctctgtcatcccacttgtaaattgtttctgggctggaggataagtgaggaggccacaggaacttttgcatgttgtctcttagcattttgagttaggaagagcaactgaaagaccgagctgaaagctacactgaacctcatcaacaattcacacactg

SEQ ID NO: 108060 - DNA, 307 bp, Homo sapiens
catgtacccagccagctgtattttgaagtaatgctaatgcaatctgaattgtaagaatatgtttcagcagatttgttaggtaagatatttgtgaaccgccaaaagtaatctctcaaatatttccaaaataataagcataatgggatattttgtccttttattgattccacattgagacagacatttttaaagttataaagagggtgggacaaaggaaacagtagtgctttttgggaaatctgattgatacaaatgtattcatatcatttatctgtatggttttgtattaactataactcattctggg

SEQ ID NO: 108061 - DNA, 236 bp, Homo sapiens
aatttccgattttttgctattaccagtgacacatatcttgatgtcttagattgttcctggagctgatggaggtgagtgaatggttcactttgagggccttcagatctgatcagccaccctctaaccaggaggtcagagatgcagattggagctccccttgtgttgttcacacagtggacatcaggacgtggtgaccacgtgttgcagctttgtatgtatgagctgccgcgtgctgc

SEQ ID NO: 108062 - DNA, 122 bp, Homo sapiens
gagtttccagctcctttggggcaggattaaaatattaattttagactttgttaggttaaaaaatgtgcatgctgtaatttctagtgcgaccacacaaaaaattaagaaacaaatatctcaag

SEQ ID NO: 108063 - DNA, 404 bp, Homo sapiens
ccaaagatggcatgataagatcattagtatttatgccaaagatagatgcagaacttctaaaggattttatgtgaagtagtgatctgataggattttcattaaaacactggttgcaggagagcaggtttgagtataaggaggctagttaggaagctattacacaaatttcaacattttctatgtttttgttcttaaaaaactctaatgtaggatgagaattcatgtttatgatagaaactaagtagctgtgtacggtgagaaggaagggaggaactgaactgagaaaggatgggataggaacactgcctgacagtttgaaaaactaataaagggtaataatgacttagaatgtataagattttccatcataaaaataatctactataccatgttacaaaactcac

SEQ ID NO: 108064 - DNA, 536 bp, Homo sapiens
gggatgaccctagggggtaggtggctgccattggctggggtctgcccctctgcagagtgcatgataatccccactttgccattaatgggaggattaaatagaaggtatagaagggtatgtggcacagacaaggcacacagtaggagcaccatagatattggctgcgtgatgatcataatggtatcaattgtctttaaaccccagtggctagactttcataaattgaagtttacttcccagtcaaccaggaccaagtttcaaaatggcttcttttcccccagggcaaggcaccctcagaaactaacgaaatcaggttacggcaaaacagtgcaaatttattttcagaaaacccaccccaagctcagagtctacacttaaagggtgtagaggtgtgagctgcagctagacgttacctgctggattctactctggtcatttctctccagagactccactgtcatcaagtgtgggatggctctgtttatgcttttgcagcctcagcctagcttgctggtttttcatgtctccctctgcct

SEQ ID NO: 108065 - DNA, 778 bp, Homo sapiens
ggatttttatatattcaatatattttaataatttacagttattattctttttattgctcaaattatttcattttacacacataagagttccttcaaacttattcctttgttatttcttcactgtaggaatcagtctcttctatttttatagaattgcacaaaatgtactcaaaggccctttctccccaacatttctaaacttagaaatatgtgttctatcttttacaaaaatgcagctagatgttatttaattttgctaagtaattttgcaaacccacatattttgtatttttaaattgttctacggtcattgacttctgatttttttctttaagttattactttttagattttggattgaacatttaactcacatgtttcagttttagtttttattaatacaggcaatgaatgcaatgtattttcctctgaatactgctgtgtctgtgtcatgtacgttatgatttgccttgttgataatatgcttattttctagcaatgctgcagtttcattctattcattgtatttcctctttaacccaagagtttttaaataaaaagttcttattgtccaagtaaagggacctttgtgcttcagccagtgtatgcttgtgtgtatatacatatatgtatgttattgatttctagttgtcttagtttgtgttccctctaaagcagaccctgagcaaagggatttgggtgcaatgcatatatttggaagacgatcccaaggagatacagtgagagactgtggatgtggtgcagggataatgagtgt

SEQ ID NO: 108066 - DNA, 415 bp, Homo sapiens
taagccagatgattaatgtcctcagagggcaaatgcatactttttgtttaggatgctctattctgactcctgcgattttggcaaggggtgctttctctgagagtatgccatgaatggcgtggccttcccttcactgtcctcatcgagcctatcccctgctgcagctgagcgcacctggtactcaggtcagagtcacagtgaagcacaaggcatggtctctgccctcacattatttacagtctagtggtgggtccaggtgctttaaatcgtggcagctacagtttatattattataactacatagtaactagtagctttatacttattgctgttttttttttaatttacattaatgtagggccttcctttgtaagatccttttatggtagcaaaatgcacaaatcttccatgtata

SEQ ID NO: 108067 - DNA, 484 bp, Homo sapiens
gctgaattgagtatgaatcctgaatttgttgaaggagctcacttccctagcaagggcctaattgcatgcctgttgcacctttgggttcagctctcacaaaccattagatcccgcttgctttctggtacctaaacttcctttcctgccctcaaactctattgtgcattaaaaaataacttatcgccagggtggtggctctcgcctgtaatcccagctactcaggaggccaaggtacaagaatcgcttgagcccaggaggcagaggttgcagtgagccaagatggcaccactgcactccagcctgggcaacagtgtaagactgtctcaaaacaagcaaataaaacccttatgctttacccatcatttccacatgtttgtagtgggacattcatattaaccataagtacctatttatcttttctatttgctgcaactatatgaaaatatatatggatataatcagactggaaaggactttgaaaatg

SEQ ID NO: 108068 - DNA, 272 bp, Homo sapiens
tgagatcgtgccactgcactccagctcaggcaacagagtgagacttggtctcaaaaacaaacaaacaaaagactttctgtcctggctgtgggttggcacccgttaaaactcagttccttgatttttcacaggcacttggcctcttttctgccttttgtggagggccctctgtttctggctgtgcattagcaaccattcttttaaacttctgattatattgaatcagcaactttaagcttgcacctgctgcttgtcatacatcctgtggcagt

SEQ ID NO: 108069 - DNA, 384 bp, Homo sapiens
ttccttgaaagaaatgtgtacttacctatgtttgtatgcatttaaatgcctaaatacagacccatgcacagatataaattttctgtctttgatatcctaaaatgactgatggtcatgtgcataaaagctagtctgagaaccctggagcctgccagacaggttgagcttctgagtaagcactgtagctattgcagtgctcagcccacacgatatgttttgcttaaagggaactatccaatccttggccggatggatgatggtggacactttggtttaatactgcttattactgtgtcactttaatttgcctaaaattgttcacagaacgttgtccttatatgtttctgggagttacttttccttgggctactgtgttggttttgc

SEQ ID NO: 108070 - DNA, 324 bp, Homo sapiens
caagtgactcatctgcctcagcctcccgaggagctgggattacaagcacccaccaccacacccagctaatttttggatttttagtagagatggggtttcaccatgttggccaggctggtctcgaactcctgacctcaagtgatccacctgccttggcctcccaaagtgctgggattaccagggtaagccaccacacctggcctagatacactttttatgctgtttgttctcgtgtagaatcagcctgccctgggatcctttgttagaaattgaccagccttatgttaagggtagtccgagcctgctgtgcagatgaggtggtgg

SEQ ID NO: 108071 - DNA, 462 bp, Homo sapiens
gcaccatcccaattcaggtatctatatcattcctactctcagaaaactgccagccaaatggtcttcttgcttctggctttctttctcttctgttctaaatactgcctcacagcagctcacctttgatgtaaagtctatcatgctatttgctaaattatgaaatccaaacccttggcctgaattccatgacaattcataatctggccactcttgtctctctaatgaaatctgcatccatttccacatgtgttctctttacccagaccagcttcctactacctcctgaggccctcagctacatttccaactccaaatatctgctcattctggaatgctgctccttccccgacctctgctgaccttaacttccctgtctcaaaagtccagcccagacccctcccaggagccttccctgacaatccagacaacactctggccccttctttgacctttcctagccct

SEQ ID NO: 108072 - DNA, 538 bp, Homo sapiens
acatcacttctgagatactttcctctcctatcaaaaagacctgtgaaaaacagtgacattttttcagcctccctccatcttttaaaattgaggccagatagacaggattttaatagatacagctacagataggctattgtgtatattagtcagagtagtgatgtcatcgccagtaggggagggagatgaaaaagctgagctgcctttcagcctctccccagtcatgccttcacactgtaaagtcctgctttggtctgaaagttaggcacatccatcaagttcggcatgcattccagagccaaattcaaagtgttttgggcattctcctctcctgtattttacataaacccttagtcagatgattgattccctctggccgccacttgggattgaatgggaggggtacgtactccaaaacaaatcataatcatattgtctttcccgcacatcctgagccattgggaactttctttttcttccaggtgaaatcaggtaaaaatgaactcagcgagggctgctttgaagggaaaaggaattc

SEQ ID NO: 108073 - DNA, 238 bp, Homo sapiens
ctaatggagctccatttaaccaacatcggccaggccttgataggagccaaggtctcagagaggcgatagagaccagcgacaagcagattccagaccctgtatggtccccttagaaccacatggccggggaggagatgcacaggtagacggtcagacctgtgtgtccaggcactgcttgctgagaagtctcagtggtcagcacacactgggaacacaacagcaaataaacagagaaaat

SEQ ID NO: 108074 - DNA, 481 bp, Homo sapiens
gccacactaaaccctgccaattttcacatgagtcagcttaaaggctcatgctttcccagtccagcttcagttaagaccacagtcccaatgtcataaaagacctaaaggcagaggtacccaactgaactgtgtccagattctggtccacataaattatgagatattatatgttgttgaaaagtgctgacttttagggcaatgttgtcagaaaggagcagatatctaacttcatctcccaggccctaggattctccatccctctacttatatcttcctcaggctgtttgcagccaaactttctaacctctgccgaactcacacctatgagtctcttcactaagggtggcttctccctgacacatacttgtgcagagatgtctccctgttgtcatccttatcatggattaaacatcaccacaatgaggccttagttcctcccatgcaataattttccagcttttcttctcaacattccacttta

SEQ ID NO: 108075 - DNA, 317 bp, Homo sapiens
tccctccactctctagatctattttgagccattaaaatgtgggtagtctgaattgagatctgtaataaatgctaagttacatcacgggtatgataagaacaaaagagtgttactatctcattagtttttatattatttacatattgaagataatattttggctatattggattacataagtattaaaataaacaacatgtgatttttcctttctaaaatacagtttactagcaaatttaaaattatgtatgtagatttaattatatttttattggagaatgctgctctagagtcttttattgatttttttctactaa

SEQ ID NO: 108076 - DNA, 342 bp, Homo sapiens
ctcaccagcaggtgccctttatggctctgtggacagactctgagcctgatggggaggcccctctgtgcagaagtcagctggactccttcgctgagctctcctgcagcactggggccttccaggatgcgtggaagagggcaatgggggcgggggcgcttccctagctgagtgctccatacgcctgctgcagaccctcactattttgccgtcaggagatggagcacagccttcgggttgcagcctggagggggcagatattcaagagcagaatttcttttctctcagttcttgttggatttatcaatgaagattcctggtgtaagttgaagacaccgtctctat

SEQ ID NO: 108077 - DNA, 332 bp, Homo sapiens
tcctgacctcaggtgatccacctgcctcagcctcccagagtgctgggattacaggcatgagccactgggcccagcggatcctatcatttttagctctctcctccctacagagctggtgtctagggcatcagggtctgggcagagtcatgatgcccctgccccatggggtgggatggggctggaggcttacaggggtgcctctccaggaggggtcccctccccatgatggacagggcagaaggagaggagggatctaggccgggcgcagtgattcacacctataatcccagctactcggaaggctgaggcgggagaattgcttgagcccagga

SEQ ID NO: 108078 - DNA, 444 bp, Homo sapiens
aaaacgagggtggggtctgtgggttgaaaaaatatattttccctcctgacaaagtaaaaaaatatgcaatgaaaaatagaagagagaaaagggggaaagagaataagatcttctatacaggcaattagtgggagtcaaaaatataatttaaaactgacaaataataaagaatactatttaagtaagaagaggtatgcatcatcatgcccagctaatttttccaactttttgtagatgtggggtctcaccatgttgcccaggctggtgtccaactccttgcctcaagtgatccacctcagcctcaatgtgctgggataacaggcatgagccactatgtccagccatccttgtacttatttctttttgagacagggtcttgctctgtcactcaggctggagtgcagtggtaggatgatagctcactgcagcctcaaactcctgggc

SEQ ID NO: 108079 - DNA, 177 bp, Homo sapiens
gaactgatcagcgagaaagccaggcctagaactcaaggtctgtttatatactgatactgtaagactggcaaaaacagtgccacttcattagccaaggcatactctgcaggacctacaaaaagtggttttttttttcttaagagtacttttaaaaatatttaaccaatactcgtctca

SEQ ID NO: 108080 - DNA, 278 bp, Homo sapiens
cagagctaaaaatagacccacacaaaggcacaccattataaaacttcatatcacagggaacaaggaaaatataatccaggcttccaggatcagggattaaacaggtcatctgtcaaagatcaggagtcagaatagctttccacttctctaaagcagtcctgaaagctaatagatgtggggaatgccttcacattttggaagggaaattatatccaagtcagaataatattttcaaccaaattattagccaagcgtgaaaatagaataaagttgttttc

SEQ ID NO: 108081 - DNA, 397 bp, Homo sapiens
ggtcgacccaaaacgactgtagaagatgctgtggtgtatagcacaaatccccaggcacaccatcgtcttactaacagctacaggagcaccccattattcctgtaggatgggatccaaaacccccagtgaaggcctaaaaccgcaaatagtaccaaaccctaatatactgttttttcctttgcatgtatatctgtgataaagtttaatttgaaaattaggcccagtaagagatgaacaacaataataataaaatagaacaattctcacagtatgccagcatcactactcttgcagctactaagtgactcataaggaggggaccttctgcagtgtggatccgctggacaaaggtagaattcaggtcctttgcaggacgaagctggatggtgcaagattt

SEQ ID NO: 108082 - DNA, 131 bp, Homo sapiens
catagacttttaaactggtacggttcttagagatggtccttggccttctgttgttgttttttttttttttttctttttcttcttctccttctccttcttcttctcttctccttctttcttctttttttttt

SEQ ID NO: 108083 - DNA, 212 bp, Homo sapiens
gataatgagcaaattgttcttttcttaactttgttcttacttttagggaagtccttgctctaattttgagaggaaagtagaattctaactgtaaaataaaggttcttggctactctgatacatatatcatctaaaagtgtaactgaccctgacagtggccctgtctcctaggaccccctcctttctcatagaatccagtacactggagagat

SEQ ID NO: 108084 - DNA, 285 bp, Homo sapiens
aggaaatgagaaccggtgcctttacatccaggccctgaggtgggcggtacaaggtaaagaccagagctggaagtgggtcaccggagacgtgaccacagcggacctgactccgcctaggttctgagccatcccttcctgccaggactgagatccgggtcccaccttctgccaaatgagcgacaaggtcctcaacttctccaaagttaaaaggcccagaagcctctgcagttttcgtcgggctggctgagggattcccgccccacctcgcccctcacagaggaaagg

SEQ ID NO: 108085 - DNA, 2774 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108086 - DNA, 1571 bp, Homo sapiens
gctgagacggtgtcactgcactccagcctgggtgacggtgagtcttgtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108087 - DNA, 1636 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatattgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108088 - DNA, 575 bp, Homo sapiens
atagctcactgcaagactccttgaatccctgggctcaagcaatcctcaacccttagcctcccaagtagctgagactacaggcacatgccaccatgcccagctaatttttttttttttttaatttttgtagagacagcatcttgctatgttgcccaggctggtcttgaactcttggcctcaagcagtcctctcgatcctcccaccttggcctcctaaagtgctgagattacaggtgtgagccactgcatctggcttacttattttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtatttttttttactgtgagttatggcaaaaaaagttttgaaagccgcttctaaataatgcagatgtcagtgctttgaccctggaataaaaactgaaatgacttagtgatttc

SEQ ID NO: 108089 - DNA, 965 bp, Homo sapiens
  misc_feature (965)..(965): n is a, c, g, or t
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaacagcgctttaaaatgactataggtaatcatggtctatgcgaaaggatgctcagaaacttggtttagcacgttcccgaaattttgggctgatccctgctaaaccagaaatacgttattaaatgctaggggggtcaggaaaagggcatggccatagaaaagtggtgtcttatatgtaattactgcgcgn

SEQ ID NO: 108090 - DNA, 834 bp, Homo sapiens
atagctcactgcaagactccttgaatccctgggctcaagcaatcctcaacccttagcctcccaagtagctgagactacaggcacatgccaccatgcccagctaatttttttttttttttaatttttgtagagacagcatcttgctatgttgcccaggctggtcttgaactcttggcctcaagcagtcctctcgatcctcccaccttggcctcctaaagtgctgagattacaggtgtgagccactgcatctggcttacttattttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtatttttttttactgtgagttatggcaaaaaaagttttgaaagccgcttctaaataatgcagatgtcagtgctttgaccctggaataaaaactgaaatgacttagtgatttcaaaggcatatttgttttcctgaacaatctataaactgtctcattaagttgtctcagttatttgcttcacttcggcaacagaacctcagcctttacatgtgtttaaagcctcttgaggcaaaggatttggaaaatatggttacatggagaatagaagataatgagagagagtatcaattcattagtgcagttgaacccctctattggaatcccatcagcgagcacaagtcccatttcaacagcaataaatgcaacaagta

SEQ ID NO: 108091 - DNA, 366 bp, Homo sapiens
ctggagtgttaaaggcacgatcatggctcacggcagcctctacttcatgggctcaagcgatcctcctgcctcagcctcccaagtagctagcctacaggcacatgccaccaagcctgggtaatttcaattttttgtagacataaggtcttgaataaccattctgtttagtacatagtcaggtccaaacaacctagtaagtatttatgtcctaacatcttgtagttgttttaagttgcccaggctagtcttgaactcctggcctcaagtggtcctcccactttggctcctagcactttgtgagactaaggtgggaggatcgcttgagcccaggagttcaagaccagcctgggcaacatggtgaaatcc

SEQ ID NO: 108092 - DNA, 2631 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108093 - DNA, 1587 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtccactgcatctggcttacttattttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtatttttttttactgtgagttatggcaaaaaaagttttgaaagccgcttctaaataatgcagatgtcagtgctttgaccctggaataaaaactgaaatgacttagtgatttc

SEQ ID NO: 108094 - DNA, 1846 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtccactgcatctggcttacttattttgtctattgtctgttccactagtatgtaaagtcttagagagcaagaatttttgtttatttctttctcttcctcctttcctttcttcctcttttacttcgttcactactgtattccacataaaatatatttggcatatagtaggtgttcaatatgttgaaggaatgaaagaatttatagacttgagttgcaatataaaatgtatttttttttactgtgagttatggcaaaaaaagttttgaaagccgcttctaaataatgcagatgtcagtgctttgaccctggaataaaaactgaaatgacttagtgatttcaaaggcatatttgttttcctgaacaatctataaactgtctcattaagttgtctcagttatttgcttcacttcggcaacagaacctcagcctttacatgtgtttaaagcctcttgaggcaaaggatttggaaaatatggttacatggagaatagaagataatgagagagagtatcaattcattagtgcagttgaacccctctattggaatcccatcagcgagcacaagtcccatttcaacagcaataaatgcaacaagta

SEQ ID NO: 108095 - DNA, 2693 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108096 - DNA, 2823 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaagacaaggtctcgctgtgttgcccaggctgatcttgaactcctggcctcaggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108097 - DNA, 2623 bp, Homo sapiens
cggtcaagaagcgtcatcaaccccacgtgctccccagcaaaagccccacgaaccctggttttcaaaacaaaaatagagttgcaatcttggcagaactggacaaagagaaaagaaaactacttatgcagaaccagtcttcaacaaatcatcctggagctagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108098 - DNA, 2671 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaagcattgcactctcgagaccctctcttaataaggacttccgggatcacgctgagcagcagcatattgcagcccaacagaaggcagctttgcagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108099 - DNA, 2592 bp, Homo sapiens
ctggagtgttaaaggcacgatcatggctcacggcagcctctacttcatgggctcaagcgatcctcctgcctcagcctcccaagtagctagcctacaggcacatgccaccaagcctgggttttcaaaacaaaaatagagttgcaatcttggcagaactggacaaagagaaaagaaaactacttatgcagaaccagtcttcaacaaatcatcctggagctagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108100 - DNA, 2602 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggttttcaaaacaaaaatagagttgcaatcttggcagaactggacaaagagaaaagaaaactacttatgcagaaccagtcttcaacaaatcatcctggagctagcatgctcatgcacattcatctggatacttcatcactcaagactctgcatttgggaaccttattcttcctgttttacctcgccttgacccagaatgaagaaaacatttgcgatggaaaagtgactttgtaatatcaaatgccaaagctactatcattcagtgctacatgaactgtgactttaagaattttggtgaactttgatattttttgtttgtctgaaagaaaggaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108101 - DNA, 2249 bp, Homo sapiens
  misc_feature (17)..(17): n is a, c, g, or t
  misc_feature (51)..(51): n is a, c, g, or t
  misc_feature (59)..(59): n is a, c, g, or t
  misc_feature (100)..(100): n is a, c, g, or t
cccgctggcccgatgangaaccgcgtggaaatgctgtattcaatccaagcncttctccntgctctgacgtgcttaagagtgacttgaatggttgtcgaangaagaatgtgtaagtgaaagctgaaagaagaataaccaggatgatgagagctgtggaagctgtatcgtccaaggaattgattatgtaccgtgactgtaacttttttgtaatgctgtttaactctcaatcagactgtgaactggatggtcacgaagtcattccccaactcctagcaagtttgactgaatatatcatgtccacagtagattttcaagaatcatttatagtacttaactttaaagaaacaaggctgcttttaaaaaatgaactaataggcttaaatcaattgcatccatatttgctgtttataggattgctatcagtataccttttgcgtttatagtcaacatgtatcatcctgaaatattctttctggacttataactacttccccctttttcactttaaaacaaacctcaagaataaattactaaccagtcttaaccatcttttataaacatatgctcttataaatgttgtgactagatgcaattaaaaataatagggaatgtggtaggtttttaatttgtacatcctcttatttagtgttaccacataaatgatgagtttgtgtggttctgttttccatttttgttctaactgaaaactttttggctgggcacggtgcctcatgcctgtaatcccagcactttgggaggccaaggcgggcagatcacttgagatcaggagtttgagaccagcctggccaacatggtgaaaccctgtctctactaaaagtataaaaaattagccatgtgtggtggcacacgcctgtaatcccagctactcaggaggctgaggcaggagaatcgcttgaacctgggaggcaggggttgcagtgagctgagacggtgtcactgcactccagcctgggtgacagtgagtctttgtctcaaagaaaaaaagaaaaagaaaacttatgcaagtcgagctcctttttaattaagtaggaagggattaggttaagaaagtctctcaacatgacccatctttagcagtatctggggtgcttatttaagtatgcagtcccactaccctaccctagtcctacagaattagaatctgattcaaaataaagtctgaaaaccatgagatagagaattctatgaaatatcttgtacagattttcgtgatatatttatacacgcatgggtttgtagatccctgaaacttagaggtcatttagctaaaatctacattttttttaacttttaataggattgaaatgatattttacactgtatcacagatacagtattttatataactttttgtaactgaccttatcttggccttgagtcccatcctctctggtggtagcgtaaaactgaaaattccagttgggtcaatatttagtgaaagttctactttcttttcagagagtttgttcccccctttcttccttagatgttttcaaacacacagccccatcctactcaaaccaagtgaagcaagagtggacaattctagaattggctgtgccatgtaggttttttttagaatttgaactgatttccttcattttgatgaggtggcaactgtccccattgtaatggtcaccattgcagcgaggatagccttacttctgcggcgcagagctcctcagggggcctctggctcctgtccttcctcaggtccatccaactactccttgggcctccttatggtagccctcattgtcttgagttgatttcactaggtttctgttctctgtcatctgcaacataactgacatggttctaaatctgtctctaaggagataacacattagtatattttctacactattgaagcctctacctaatgtatgacttttgtagctcaggtaaagagatctttttaccagtgttatcgtttctagtctgtttgttagtcttcttttaaatagatatggcctaaatcctgtattcctggctaggaagcacttctctccacccctctgctttgagttacaaattcaattcaatttcctatgtatttattaatacctacagataaagtactgtgctttgggggacacaaaggtgactggtacctgctcttttaggaggtcaccgtgcagaggatcctattctggtacaccaatagttataaagcaagccacagcctgggcaacatagtgagacccctgtctctactaaaaaattaa

SEQ ID NO: 108102 - DNA, 1089 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaaggttttcaaaacaaaaatagagttgcaatcttggcagaactggacaaagagaaaagaaaactacttatgcagaaccagtcttcaacaaatcatcctggagctaggtattgacactataatgtgggttttttgtttgttttgttttgttttgttttgagacggagtctcgccctgtcccccaggctggagtgcaatggtgcaatctcggctcactgcagcctccgcctcccgggttctagcgattctcctgcctcagcctcccgagtagctgggattacaggcacctgccacgacacccagcaaatttttgtatttttagtagagatggggtttcaccatgttggttaggctggtcttgaactcctgacctcaggtgatccacccgccttggtctcccaaaatgctgggattacaggcgtgagccaccatgcccggcaataatggatctgagggaagatactaaatatggcagagactgaatacctataataaagatcatcaagctacctaaatttggcctactttgcagaatgattaaaaagtggggcactagcagcaattgcagtaataaaaaaccatacaaaactcaaaaaaaaaaaaaggctataagggctaggtgcagtggctaacgcttgtaatcccagcactttgggaggctgaggcaggaggatcacttgaggccaggagtttgagaccagcctgggcaacacaagacctcacttgtttctactaaaaaacaaaaaaattagccaggtgtggtagggtgcacctgtagtgtgagatactcaggggcgatcacctgagcccaggagactcaggatgtagtgagttatgattgtgccactccactccactctaggtgacagagttagaccctgtctc

SEQ ID NO: 108103 - DNA, 688 bp, Homo sapiens
agcggaagcgcagcgggggcgggaaggttgtagtgccgcgagttgagctcctcttgcctaagtggtcgcgccccctttaagagcagcgattgtaaggagaggcggtcccggtgtcctcgggtcccaggtgattgtgaagtgctgaccaattgccactggacatacttgaaacaaaataggaaaatggcagcaaactcttcaggacaagagacagggtcttgctctgccgcacaggccagagtgcagtggcccatcatagctcattccactgagcccaagtgatcctcctgcctcagcctcctgagtcactgggactacaggcatgtagcaccacacctaactggaaaaaaaaaattttttttttaagagatagggtcttgctatgttgcccaggctgatctcaaactcctgtcctcaagtgatcctcctgcctcgacctcccaaagtgctgagattacaggtgtgaaccactgaacctggcccgtttttaaataaaaataataatgcaaataagaaataatttcctaaaagatgtctcaggtattaagacacctagaaattcagaaaatcaatgaaaataattctgtagcctggaattcaaacattattgaagtctgaagaacaattcccttctctacgtctgtatctggagggaaagaaggctattatatgagagtcactgtggtgt

SEQ ID NO: 108104 - DNA, 1220 bp, Homo sapiens
aagtgccagaaagatgattagagattagctgctgaaggagggccagggctgggaagaatgttccaagatcagggaacagctgtgcaaaggcttggaagaggaagagacattgggagcacagagacttgattatatcagtgtttgggtctcattgaggcaggtggcctgggtcttgtgggctgtagggagccatagaagggttttgaacagaggagtggcatgaacgttttatagactggtttggtagacaactttggaaaagcaagagatggtccacgtacacacatgagcctggaaggtgaggagaactctaatgtgatctgaattcccaaaagcagtccgtttggaggtgatcccatacagactcctgggcctggtccaagacttagtgaatagactctgccctcgaataaggttttaacaagtgcttcacaagattctgagcagccagctttgggaagacttaaattggatgactgtccaaaggtctccagtagaagggctgggtcagtttacctctctgaggttgttttatcatctctaaaattgggggcatgggtgaggtttgaactcagagcaatgctgtaaaacagatattgttttcacccccatttacagatgaggaaatgggcttggagaggtttaaacagcttacctcaaaccatgaagccaggaagtggctgagtctgagtttaacctttacatttatacagcattttatgggtctatgactttattcatagagttttccatgtctggtgtggatgagtctcctttggttcttgtggcctaggtagttatgctgagccccatagatagtgaaagattaggtccagtccttttgcttgagttgcttacagtctggccatggccagcatataaacagaaagttatggtgcaaagggaaacctgttctcccagaggggccaagggattgagaggagagagcctctagcaaccagggtgttttagtccattttgtgctgctataacaataccacagactggataacttataatgaacaggtatttattggctcacagttctgggtgctggggaattcagtgtcaaggggctggcaacttgtgagggccttcttgctgtgtcatcccatggcaggtgagagggcaagagagggcaagagggagttgaacttgcccttttataagggtgtcaatccacccatgagagtgcagccctcatggcctaataacctctt

SEQ ID NO: 108105 - DNA, 769 bp, Homo sapiens
tgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttat

SEQ ID NO: 108106 - DNA, 398 bp, Homo sapiens
aaacaaacaaaactgggctagaaaacagtaagacaagagagtaatattgtcaatattgaagcaaaatgattttgaactctgaacttcgtacctgggtaaattattaactgacagtatatacatttccacacatatatgggctaaaatttatatttcatacacatcttctttggaagttactgaaggatacccttcaggaaataagaaaagcaacataaacacataggatctgagaaaccatagatataacctagaagagcagaaggttccaaagcaagacttatgtgatataggctgacagacccatacaggtgggagtgagagaccagggactcaagaaaggctgtttccaagaaactgactccacacaacagaagtgtaagaaggtaaatgacccc

SEQ ID NO: 108107 - DNA, 917 bp, Homo sapiens
aattttttgtatttttagtagagacggggtttcaccatgttggccaggctggtctcgaactcctgacctcatgatccacccgcctctgcctcccaaagcactgagactacaggagtgagccactgtgcccagcctactctggttttagtgcattcaagaggaacaaaaaaggaagaaaatcactagtaaatatacctctttctggttagagtggatgtttggaaattatatatatattatataatatatattatatatatacacaaacacgtacatacatgcacacacatatatgcctttttgattataggatagtataccaaaactcagaaatattatggaattaacagaatttagtaaggcagataagtagtaggtagaaaaatattaattttatcttccagcagaagcactgtgaaaaattagacaacaagaaaacattccattcaaaataatgacaataaggccgggcatggtggctcacacctgtagtcccagcactttgggaggctgaggcaggaggatcatctgaggtcaagtttgagatcagcctggccaacatggtgacaccctgtctctactgaaaatacaaaaatcagccagctatggtagtgtaagcctgtaattccagctactcgggaggtcgaagcagaagaatcacttgaacccaggaggcagagattgcagtgagccaagatcctgccagtgctttccagcctgggcaacagtgtgaggctccatctcaaaaaaaaaaaaaaaaaaaagacaatagcaataaacattaagaaatgtgtaataggaatggcacacacaaagaaggaatggcacagagcctgtatgcagaagaccacaaacccttatttaacgacgtaagccaagatccaaagaaaatgatagattctcagatgggaaaacta

SEQ ID NO: 108108 - DNA, 327 bp, Homo sapiens
gaggggccagtactgagtggagagacaaggggtgcaaaggtcacacacttgtaacaaatcataatctgagccctgtatttcaaaaggagctatatctgtgggatctgacactcaaatatttcattctagcacggtaggcacatttgcattcgataaagcacgcagctgcattgcttttgaagaaagccacatttaataagcgttcaaaccagtatcgaccagccaacaccccttgtataggattctgaggctatcagggattgtagatttcatatagttaatcctccatcccataatatgattccagtaacgatccttctctttgat

SEQ ID NO: 108109 - DNA, 257 bp, Homo sapiens
gaagaggaccaagttggagtcaaggagatatattagaaagatactatggtcatccaaggagaaagtgatgaggtcaggagaagtggcatttgagaagaaggatagatttgagaggattataatcaggagggcttgattggtgactaactgcttttggttaaatagtgaaaaagaagagtctgggcttttagtttgagcaactgagtgagatctggcattcactgggaagggaaatagaagaaaaggaaggatttggg

SEQ ID NO: 108110 - DNA, 217 bp, Homo sapiens
ctggacaaatatactgcccttattctctggtatttttttgttttaaatttgaacagttttgaaggagtaagactgatatgtaaatatatatcaggatatcattttctgaacttagattgaaaaatatgtttcttgacaagtgctcttgacaagcgcatgttctgtagtaattgaagaacatagctgggagaggtggctcacgcctataatccctgaa

SEQ ID NO: 108111 - DNA, 700 bp, Homo sapiens
gtgactacaggtcctccccaccacgcctggctaattttcttgcatttttgatagagatggagtttcgccaggttgcccaagctggtctcaaactcctgagctcaagcaatccgcccaccttggcctcccaaagtactgggcttacaggcgtgagccaccggacccagcaaaaaaattaaaactgataataataagtaatgtaaacatatgaggcgatggaaggtcactgttgtttgaagtataaactggtatagcctttttggaaaataatcacaatatctcaaaaaattaaaaatgaagattgaaaatacctccaacattttcacttctatgcatataaactagaggaatttctcaaggagattgggtaagaatgtttgttgtgttatttgtaacagtggaaaaagtatactgtaaatctgttcaagactaggtaaatgtaatatccataaaatggataacagtgaaactatatgtattgttttctttttcaagccattaacatggattattttggttgtaggttaaatatgttctgtattataaccctctccaactgtgtaggaacagatttgctaatttacgtttgtagagttttcccttaagtgatcattattactgatatttccctaaattcaagatttttttccttaaacattgacttctcttaatctattcaaggaaaatagtagtattcaaa

SEQ ID NO: 108112 - DNA, 440 bp, Homo sapiens
gcagaggcaattaacaggctcgcagttcccccactgcccacatcctgaaaaacatgtgggcattaaggaggttgttctgataaaggaagcagcccctctccttgggtcgtgaagctttttagttgcatgactgaggcactagcccctctcctggcatgctcatggtctagtgtccaagcctactgctccagctttgtgatggggtggcacttggcttcggccctactctccttttttggctttcacgtctgggagtgccccgagtcctccctgcataatcaaaggctagcattcaagacttaaaattgcaggggcaggatgtggtcagccacccaatggcctgcaacctggatccactgaagcaggttttcatggagcaatttagttcccaaatagtttgcaagtggcaacttgagctctgagtggccggcctgcacagg

SEQ ID NO: 108113 - DNA, 593 bp, Homo sapiens
gtttaaagaaaacttttgagtttttagaagttggcacatcatatactgtctatggcttaaaaaacctctagctttgtcagttgtgttagctctgataaactttgcaggtcttcctggaatcagagacaaagcaataaacaataaattgttccgtctttagatgtcagcattgcttatgttacatcattcctcagatgtaaagtatatttgaagggtttttttagtttttttaaaatattttgctcttctgcagactaagagcccatgtttatcccattaaatatattttttgaatatagatacggtttttcattaatcttcacagaaggatcactatagatatctcatggttatatgactttatttctaagtctgggttttaatgacacttttgcatgtaggagtccatctctaataagcaatagcttgtgaaacagcttttaataaggtcatgaaattctgatccagccccttggcagatgtctctgactcttattcagagctctttttaagcaacgtgtctctataggctaaaagctataaccctaaaaatattttgagaatttacatacatacatagatacatcatatat

SEQ ID NO: 108114 - DNA, 276 bp, Homo sapiens
gtttttatgcacagatgtagatgtagagggaacttagaaggaataagtcaaccaatggaaatgtcatcagtgtaaattttttcttttctaggagtctgcccatgatgaaatgccttaggtcttccttacctttttattggcagtcacattataaagtgtcttatgacatgtctcttaatgtatatttaaacctttgaattactcttttactttttatatcaagccatatgtacccaaaatgggtcataagtttgagaatttaatactttcgttact

SEQ ID NO: 108115 - DNA, 244 bp, Homo sapiens
gttttggtatcaggatgctgctggcctcatagaatgagtcagggaggagtccctgcttttcaattgtttggaatagtttcaaaaaaaagggtatcaactcctctttgtacttctggtagaattcagctgtaaatccatctggtcctgggatttttttcattggtaggctattattgccttaatttcagaacttgttactgatctattcagggattcacctttttcctggttaatcttgggaggg

SEQ ID NO: 108116 - DNA, 744 bp, Homo sapiens
gtgatttgtgtgctgggtgcagtctttagtttcttagattataaatttctaattgtgctaaacccattccgcaacttaagtaaaagtagggttaatggagagagaagtgtaaaatcttccaaaaatcaaaacctgaatgaagctccccaattagagattgtagtgttgtttccgtatggctactctgtggtaggaagcagagagaaacagtatattgggatatttaagtgctcttttgtcttgtaaatgaggaatttctgtgttgaattgtgtgctgagatgaggagattccataaattgttatggtgttagttaattattcagatagcattagataagaatacatttatcaatgtttcatttctttcttaagttttaaaaatgcttagcatagtcagattctatctggtaggagtaagagaaattattaaaccttaaccattgtagctggtttttaaattttttcttcataatttgtattatactgtttccacaagttcaatactcatggaaaattctgtattttaaaaaagacttttgttagaaaagggaacaggtacttttttcttctggggatacatgctattgagtacagggactggcctgggttagtagactgtgtactttgctgttttgtacatctttcatctgtttctcagaccccacatctgtatcctcgtggcacctttgtgcaggcagtctggtccctggaataagacctgctgttttgatttggtgattccc

SEQ ID NO: 108117 - DNA, 325 bp, Homo sapiens
aggcagtggtggggctcagccttgtccaagctcacacaacactaagcatgatgtgagggcagagaagggcagggccctggcccaaatcatgcagcctctctgcttcccacataacctcactgtcacctgcttgcaagtgaacaaggggcaggggaaggaagttttgggagatgaaggcagccaatagaagaggaagaggaggttcaggcccgtgtccacacactaagactcactctgcatggactaagctccatgcagaccaaggccccaggtcgatctcaaacaattgtcaattagagctgagcccaagaagtccaatcctggg

SEQ ID NO: 108118 - DNA, 305 bp, Homo sapiens
taccagcctgaaacatcaggctggctccaccctgctgcagttggaggttaagcattgccctcgatttgctttgcccagtgaaaggtgcaacacttctagagagaagttctcagagctggttaattatttggcgtgtgctcttctctgtaacagtaaagcctctgccagccagaatcactgagtaccaataaagaatgaaagctccctttctgcctagccaaggtggacataaaacttgagcaacaggtaaaccttgattggcccaagcactgagagctttttagtattgcaataaaagccagact

SEQ ID NO: 108119 - DNA, 565 bp, Homo sapiens
gccagggatcataatgacaacaatcagttgaagaaaaaccaggaccaagcaaaccaaagacgcaccagtaaactgcacaggggacagcatgtggtaagttgaataaaataaacatggcaattcctattcccttgctggctattgcccaagtttaatttggcatatgaggacataggccatgtcacagttatcctagcaaaacaaatctgagaacaccttacttggggccattttaattctgcctctgatagtctacctctcctatagaatatcacctgaccttgaattacattacagatctcttagtcactatattactctttaggaaagatataaattttactatctaagtcaaagcccctgcgtcatgattattccaaagtttcattgtcactggcctatgactaggaaactaattttataatcagcataaaactatttatctcacctttggccaagtagccagtgacatcattctcctatatcaagaaatcagtctgtgaacagatgaaccacgatataggcctagtaataatcttatgcacgttaaaactgttgtcgacgc

SEQ ID NO: 108120 - DNA, 1533 bp, Homo sapiens
atgtttgagaagacttgtttatttaaatatttatttatttttaaaagactagtcaagtggaagtggggaaagagtggtacaacgggcaaccaactgtgaataaccaattgagacaattcactaccttgggaccagccaaagcttgctttttaaagtaaccttgaaatacataccatattccatattatacaaagctttacatattgctcttagttttgaaatagaaaaagaacttttgaagagaataagaatcataaaactaggtctaaaaattgtaacacctgttcttcataaaacatatataactttatttacattaatacattatttaggaggttcaagcctttaacataacccttcccattaatctataactgtaaagagttcatgtatatttctcattttctgcacatatgtattaatgtaaaaaatttgtcctgccgtattttttttagtcaacaattatctggagcattttatcagttcgtgattcaacttctaatacatatgtcgcttaagagtaaaaagcccctccataacttgaaaacatcttttttttcttaacctgaaataggcttaaattctcacattgtcagatgagtcttaacactttagtatttgctaaatttagcatattaaaattttttaaaaggagtataagggccctaaattggaaaaaaaaactctactacgatcataactgtgggatttcatttccagttcattctgtcagaatcaatctaaagtccatgtaatgtaaacagttcgaaaaaagtcttaaaaatgaattgttgactttaaacacacaatcttcggagccgctcacaacgtccgtagaagcagactcctccccgctcctggggaaaaccctgcctaatatttataacgttatgacatactgtaatactcacaaggtggttgtagaagtataaacacgactggagttatctgattggctgctggtgatgtaacacccatgtcaatacttcccagtgaacgcacgtgttcgaccttttatttaaatttccatttcatcacagcaataagacactcggggcggtgcattttctgtgaaatgactactgtccggggcccgaggtgctgcctcgcacaatgcatcaaaggaggttgtgtccgtggtcgtaacctcttcgcgtgaaaggcaccgcctggtccagtctttgtgaaggaacaaaataagttcacttccttgggcaccgccacccaccctcagcaaatgacaaggctggagcgcagctcccaccgcacagttatttgcaaagtcccaggtgaactcgtggcgagagaaggaaaatgcgcgtcccgggcgcgggtaggtgcgtgtgggcagcggggaggcggccagaccctgacactcgccagctgtttgtcctccgcgtagcccggccccggccgcacacgcccgccccctccctgagacccccagcccgccgcccggccttttgtccccaacccctcggccgacttccttccccgcggccgcacccccgcccccaggccggaggcgcagcc

SEQ ID NO: 108121 - DNA, 1479 bp, Homo sapiens
atgtttgagaagacttgtttatttaaatatttatttatttttaaaagactagtcaagtggaagtggggaaagagtggtacaacgggcaaccaactgtgaataaccaattgagacaattcactaccttgggaccagccaaagcttgctttttaaagtaaccttgaaatacataccatattccatattatacaaagctttacatattgctcttagttttgaaatagaaaaagaacttttgaagagaataagaatcataaaactaggtctaaaaattgtaacacctgttcttcataaaacatatataactttatttacattaatacattatttaggaggttcaagcctttaacataacccttcccattaatctataactgtaaagagttcatgtatatttctcattttctgcacatatgtattaatgtaaaaaatttgtcctgccgtattttttttagtcaacaattatctggagcattttatcagttcgtgattcaacttctaatacatatgtcgcttaagagtaaaaagcccctccataacttgaaaacatcttttttttcttaacctgaaataggcttaaattctcacattgtcagatgagtcttaacactttagtatttgctaaatttagcatattaaaattttttaaaaggagtataagggccctaaattggaaaaaaaaactctactacgatcataactgtgggatttcatttccagttcattctgtcagaatcaatctaaagtccatgtaatgtaaacagttcgaaaaaagtcttaaaaatgaattgttgactttaaacacacaatcttcggagccgctcacaacgtccgtagaagcagactcctccccgctcctggggaaaaccctgcctaatatttataacgttatgacatactgtaatactcacaaggtggttgtagaagtataaacacgactggagttatctgattggctgctgatttaaatttccatttcatcacagcaataagacactcggggcggtgcattttctgtgaaatgactactgtccggggcccgaggtgctgcctcgcacaatgcatcaaaggaggttgtgtccgtggtcgtaacctcttcgcgtgaaaggcaccgcctggtccagtctttgtgaaggaacaaaataagttcacttccttgggcaccgccacccaccctcagcaaatgacaaggctggagcgcagctcccaccgcacagttatttgcaaagtcccaggtgaactcgtggcgagagaaggaaaatgcgcgtcccgggcgcgggtaggtgcgtgtgggcagcggggaggcggccagaccctgacactcgccagctgtttgtcctccgcgtagcccggccccggccgcacacgcccgccccctccctgagacccccagcccgccgcccggccttttgtccccaacccctcggccgacttccttccccgcggccgcacccccgcccccaggccggaggcgcagcc

SEQ ID NO: 108122 - DNA, 434 bp, Homo sapiens
gctaacaaataccgacatagacatgaagtgagaacatgctgttggaaaaatggtgccaacagacttgctggatacagggtttgcccacaaaccttcaatttgtaaaaagcaaaaaaaaagtcaactgcaaaaaatgaagcgtgcctatatcctccgtgagcttgtatactatccccacttaccctcccagaattttaccctgaatgcatttcctatgctttcaagtcttttatcaccctagcatataaaaatatgtacataaacttaacttttatttaacttctaggcattaacatttttggtttgaactgttacaactgcaattattagtaatgcaaaacaaatcaaaacaaaatatatcagaaactttgatagataattatgatattaaaagcaaaattatattaaaaatgcttttcaagaggaaaaaaaaa

SEQ ID NO: 108123 - DNA, 796 bp, Homo sapiens
tgtgtaaaggatatggagcctgtaaaagcctttttttttgggaaattctttttttaaaaaaagggttttttggaatagaccattgttgtggaaaaagatttatattcgacaaaaagtggagtccaaatttttttaaaaaaggattttggtcaaatctgggacatgggttaagcttatgactggtttagaaaaatattttagaggggtttttacgattttaacccattgggttaaagtggggtttatttgacggctttttttggggagtttccacgggtttttccccactaagatttcgaataaccggccaatatgggtttatgttccggacgttttcgtgagtgggccaagtgggttaaaaggtgacgggcgaaataaagattgggctgcgaaaatgattaagttggggaaagtcgggggttttttctgtattttttcttgtttatgtattggtcatttttttttttttttttttttattttttgtttttttttttttttttaatttttttttttttttttttttttttttttttttttttttttttttttttttttttttttttttttttttttttttttttttttttttttttttttttttttcttttttttttttacataaacttaacttttatttaacttctaggcattaacatttttggtttgaactgttacaactgcaattattagtaatgcaaaacaaatcaaaacaaaatatatcagaaactttgatagataattatgatattaaaagcaaaattatattaaaaatgcttttcaagaggaaaaaaaaa

SEQ ID NO: 108124 - DNA, 113 bp, Homo sapiens
cgctgaaatgaggcttgccatggcctggcagatcagactgttcgagaaagaggggatgtggcaggcacaagaggaaagccatccaaaaggaatagaaaagggatcaggggtca

SEQ ID NO: 108125 - DNA, 380 bp, Homo sapiens
cttgccctctgctactcttcacacagctccttctcttcgcatctgttgggtctcagcttgaacggtatctccccagagaagccctccctggccacgcttcgtggcgcctgtttgcttccccatcacacttctctgaagctctgatttagctgatgatgagctgatttcctagctctgtctcccacaagactgtaagctcctggagggcaggggctatgttggtctcatccctgactgtattgacgccaatgtgtatagcacctgacacccagggagtgctcagtaagtaaacatctgctatattaagccggctgtggtgacacaagccagtagttctagctactccggaggctgagacagaaagatctcttcagcccagg

SEQ ID NO: 108126 - DNA, 118 bp, Homo sapiens
atttttctttctaaaatctgtaagatgattttacagaaataaaaacattagaagctatgatcacaccactgcactccagcctgggcaacagagcaagaccctgtctcaaaaaaaacca

SEQ ID NO: 108127 - DNA, 1080 bp, Homo sapiens
ctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaagtaagtacagataatttttttaaaagaggttacaacttctaaaaagaaaagttggaagttctaaattgctagtacttaaagaactgccagaattctgttgagcattttgaggggaaactggtataatttagaagtacttcacttaatgtttcctatgactcttttttttttttttttttaaatgcagaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcaggttagtgaacaaatggaatagagtttctagtatatacttgatttaacttccatttgtaaaattttccatagccttgccttcaaaaagaggtccccagggcctgtagcatttcccgtattataaattgtatgctaaaatatggctgtttgtatactacttaattcttcttgctaaattataaacccactgggcaccaactataatagcaagtactagtaggtaatgttttgattgaattcatgttaacacttagccatgtccattaagttcatcccaccaagaggtatctcccactg

SEQ ID NO: 108128 - DNA, 1320 bp, Homo sapiens
ctgtgtgtggaaagatcacatattgtgtagaatcgtggcgagagctcacaacgggcctgtgtttgccatgtacaccaccctgcgagatggacttatcgtgactgggggaaaggaaaggccgtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaagtaagtacagataatttttttaaaagaggttacaacttctaaaaagaaaagttggaagttctaaattgctagtacttaaagaactgccagaattctgttgagcattttgaggggaaactggtataatttagaagtacttcacttaatgtttcctatgactcttttttttttttttttttaaatgcagaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcagatttagtccggattcccggtatctggcagtaggttctagtgagaactcagtggatttttatgacctaacgctgggccccactcttaacagaatcagctactgcaaagacattccaagctttgtcattcaaatggacttctctgcagatagcagttatctccaggtctctagtggctgctataaacggcatgtctatgaagtgccttcaggaaaacatcttatggatcatgccgctattgacagaattacttgggctacatggactaggtaaatacttatatattcacaaggcaagaactgactttgaaggccagttagaaaatcctatttctgaactgttagagccattccaataaggaatagtaattgagtttcaagtttttgttaccatattttgaaatggtatgttcatgttgggacccctttttattgaatatatttccatgttttatcagtttccatgatttatcaagtttttttttttaaggaaatcaaagttttaactttaaagataccctgatatttttcttaatgct

SEQ ID NO: 108129 - DNA, 1170 bp, Homo sapiens
taaaattcactgaaactggatgtttattttgaccgagatatagtatatcctcaaattgccatagaaagtttacaagaatattagaggtaaattataaatatcagggcctttttaaaaaaaaaagattctgcttataacttggtatttgtttataataaaaattatagtagccaataatgaacacttactctggcttggttatttacttaggtcaaaagaaggaggagcggttaaactgtgggatcaggaactgaggcggtgccgtgccttcaggcttgagacaggacaagccacagattgtgttcgttctgtgtgcagaggcaaaggcaagatccttgttgggacaaggaatgctgaaataatcgaagttggagagaaaaatgcagcttgtaatattttagttaacggtcatgtggatgggccaatctggggactagcaacacatccttccagggattttttcctttctgctgcagaagatgggacagtgagactttgggatattgctgataaagtaagtacagataatttttttaaaagaggttacaacttctaaaaagaaaagttggaagttctaaattgctagtacttaaagaactgccagaattctgttgagcattttgaggggaaactggtataatttagaagtacttcacttaatgtttcctatgactcttttttttttttttttttaaatgcagaagatgttaaacaaagtgaatttgggacatgctgctcgtactgtgtgttacagccctgaaggggacatggtggctattggaatgaaaaatggagaatttatcattttactagtgagttctctaaaaatatggggaaagaagagagacaggagatgtgcaatccatgatatcaggttagtgaacaaatggaatagagtttctagtatatacttgatttaacttccatttgtaaaattttccatagccttgccttcaaaaagaggtccccagggcctgtagcatttcccgtattataaattgtatgctaaaatatggctgtttgtatactacttaattcttcttgctaaattataaacccactgggcaccaactataatagcaagtactagtaggtaatgttttgattgaattcatgttaacacttagccatgtccattaagttcatcccaccaagaggtatctcccactg

SEQ ID NO: 108130 - DNA, 506 bp, Homo sapiens
ttcactgaaactggatgtttattttgaccgagatatagtatatcctcaaattgccatagaaagtttacaagaatattagaggtaaattataaatatcagggcctttttaaaaaaaaaagattctgcttataacttggtatttgtttataataaaaattatagtagccaataatgaacacttactctggcttggttatttacttaggtcaaaagaaggaggagcggttaaactgtgggatcaggaactgaggcggtgccgtgccttcaggcttgagacaggacaagccacagattgtgttcgttctgtgtgcagaggcaaagtaagatgttccatgagctgatacagtgcagcagaaaacagaaagtggttattactgtgattccctcaccctttgcagcctaatgaacaatacttaataatgcataacgatggatttgcttgccaacattactctgtctttgctgctttctttgccaaagttagcaccagtgtggtgcataagcta

SEQ ID NO: 108131 - DNA, 380 bp, Homo sapiens
ctcccaggttcacgccattctcccgcctcagcctcccaaatagctgggactacaggcacccgccaccacacccggctaatttttttttttagtatatttagtagagatgggtgtttcaccgtgttagccaggatggtctcgatctcctgacctcatgatctgcccgcctcggcctgccaaagtgctgggattacaggtgtgagccaccgcacccggcctgaactctgtttcttacgcagtcttagacttccaggacaggattcctaggtaagaggtactatccccatatattcactgacacaggtaagctccatttctatcccaaaattagagtagctgggtgggttacacccaaagaagtgtcagcaaagataggcccc

SEQ ID NO: 108132 - DNA, 426 bp, Homo sapiens
cacagtatgacagtaataagacactttatgaagaacatattttcagtagctaagtgtcatagaaaaggaagcttgttagccatttcctcaagttgacaacagagagtccttaggaaaataattttttaaagccaatattgagccttccaagactgcacatggtgatatgttaaatttggaatttatgcaacttaaaaaactgagagtcgggggttggcatttttgtgcatcctaactgacgagtgctgccccagggctctctaacactgcacacagtctactaaagaagcaggctgcccatcatgacccccacccatcagctacacagcacacatctgcttctagatgaaccttcttgcaagtggcctgtcttatggcaaaatcaaggggcaggcctgtaaagcggaccaggaaatgagcagcaac

SEQ ID NO: 108133 - DNA, 124 bp, Homo sapiens
tcctgcccacccgtgaacttttatccagtcctttctcttgtctttgtttcctgagggtgggcacaggcagtcagtggcagagaaggtggtctgctcctagcgtggctgggggaggctctgaggg

SEQ ID NO: 108134 - DNA, 465 bp, Homo sapiens
agtcatggagctcttctgccttccacaatacctctaaaacagtgagggccattctgaatatttgttattcatagaccccttggggactccagtgaatgttgtgaaacctgtctctaaaaaaatgcacatgtacccgaaatgttgtgttgaattccaggggctccggtgaaatcgccagtaggtagaggatacctctgctttctgtgtcgtgtgcaaaagattatttctaccgctgacctgttcaactctgaataggtgttaacagacatcaggttagaggtacagggctcatacacagtcactgaacttcatcttgcaagggcaatctccaacacactttctacatgcctacttcctgaaattaaagttcaggtagcagtgccttctactttgggccaaactttaaccttagaaggtttgaaaatttggggattatgtatcctaacattaactagaagatttcaa

SEQ ID NO: 108135 - DNA, 695 bp, Homo sapiens
ggttataacatcctactgtgctcaaaaagctggggtctctgtagtgtataaaacaaggttcctacccaagaggatgtacaccctcgctaataatatagcaaacaggcagtaaaccataaccatttattgaagtacttaaaaagtggcagaaaacattatgggctaaagcagtcttcacaagggaaaatttcataaaggatacatttttatatatggaccctgaaggagaaaaaagtcctatataattttttgaaaggtgataaaggtattccaagcagccaaactggtatatacagtagctcagagatagaaatgtgcttagtctttctgacaccctataagttaaccagtttagaccatgtggagtattaatggaaaggaaatctgagaggactcatttgatagggagtcagtgaatttccgagcccaggcttaagagtttggaaccaggggaatcccttaaagcatcttttcccgaagcatattctgaggttaaataagtgttccattaaaaagggggatgggggagtctgtaatccggtaagcctggacaagattaggcttccagcaccttaatatcctgtgtacacttgcgagttgaaaatagaatatatagttttcagtgtttcctaaacttacttgactgaggaactttttttgagatgcatcttgaagttccagtatgaaacacactt

SEQ ID NO: 108136 - DNA, 279 bp, Homo sapiens
ctgaggagtggtgatattaatatgacatttttagtattttattaaaaactacatcagcacttagaagcgctgaaaatctcagtgaaaccatttcccaaacgaccaatacatgatgttataaaatcaacaatgaacaaaagatccattcaaagtacaagatagcccaatggatttcaatgtaactgagtaccaacaaatccactagatttcacactgcaactaacctttaagaaatctctacttggccaggcgcggtggctcacacctgtaattacagaa

SEQ ID NO: 108137 - DNA, 278 bp, Homo sapiens
tgctctgggatatgggggtggctcataatctgtgactctacatacctagtggggttctcccttggtaacccgtagaaatgccacattgtgtgctgaacttcctctgagtagagtagactcatgaagatttttaagaatgcttttataatcttaggaactgcatgggcatatatataatcttagaaaaagttattactatcacacacttactttctaaaagcagctcctcatttcttactgcctcccacccttgaaacagtcttgcatcttgcctcttt

SEQ ID NO: 108138 - DNA, 492 bp, Homo sapiens
atggatttgcctcttgtggacattttgtagcccaacaatattccactgtatcaatataccacacttcgtttcttcactcatcaggtgatggacattttgttgtttccaccttttggctcttatgaatagtgttgctttgaacgttcatatacaagtgtttggacatatatttccattttttcgtgtatatacccaagattggatgctgggtcacatgcttatttagttgtgaaacgttactgtcaagttgatctaacagaaaaccacagctgacctgatgttaccactcagggtgagcaacgccctctagcaggcaggctcttatggggaagagaagtatggatacaattaggcggactggctgttagttaaagccacctggaaagggtgctgactctcagattcgctggtgacacaaagttggggcagaatctaggcccaaaagatctcagcaagctggtgtgatgtccacagataaaatatagcaaagaa

SEQ ID NO: 108139 - DNA, 646 bp, Homo sapiens
gtatacagacatatctttgtacatttgtgtgcagttttatgagccccgatcatacttgcacatacttttgcacgtgtccatgtgtatcttgttctcagacatgtgcattcatacatttgcacatgtgtatcatgcacatgtatctacaaaggcatgctagataaataatgaaataggttcataattctattttgtaatgttcttcacacaatgttattaatgtcttctatataaaatatttttaatgtctgcatggcatgtaattgtatggctgaatcataatttaactaattgcttatctttggtcactaagaatgtttacagtttttttcattgaaatttatttcacatacgtcttcaaccgtttccttagcataaattactagccatggaaatgcctggtcagcgaatatgcatttttaaaaggcttttgaattatagaatgatggtgaattgtccaggcaacttgataggagcatgatactctttggttgtcacacagggctgttctgacttctatttgatctggttaatcaaattgagctagttttctcaccaagtaaatgtaatggaaaactgtatgattcattcataaatgcaaacacagttttgtctttatggtctttttattggtagtgtaatatgt

SEQ ID NO: 108140 - DNA, 214 bp, Homo sapiens
  misc_feature (12)..(12): n is a, c, g, or t
  misc_feature (18)..(18): n is a, c, g, or t
  misc_feature (20)..(20): n is a, c, g, or t
  misc_feature (37)..(37): n is a, c, g, or t
accgcactagcntatgcngngcactagcttatgcagngcatagcctcatcgctaaggagtagggtgagaaacgcccacccagaggcacccagggctgcgcatttgacggggccttgctctttccaagaagagacagacttggcatgttacctatctgaagggggcgcagagtggagtccctgaggagaggatgggatccaggcggtgatgggat

SEQ ID NO: 108141 - DNA, 2059 bp, Homo sapiens
gtgaactggagtaggtgaggattctgcagttgacgccccaggatggctttgctcagccctcccccgtagactggaggaaagcctaccgccaagggaggagaggatgcatctgtcctaggtgcagccggcctccctcttccaggttcagcaagggtccctggctgggcattttcctcgtaacctttggcagcattggctcaaatgccattgtttagattcccagatatttccccactgctttttgtgttaaggtagtttggtaaaatgccttattccaatggcctaagataatatcaagcaactcactggtttacttttctaaccagctgtggttaagacacacacggcaatgtgctatctttcacatgttggacgttaaacccagaccaactccccaaatctaatttgtttcagtaatttctgaatgcattgaccaagatattcctttcatctctggttgagtttcttccattagaaggaaggattaaaccttggataaaagatttgcagatgccccagtggttagtagaggtgaaaatggaggtttcagggaaactgctggggccttttgcctttgtcctcatccaaagcattttgtgcctctctttcttctcctctggctgaatatccactggagattgaattctccgaaactccctgtgtgggtgaagtgggaagctgtgcccaggaaggggagtaactgtgcaaagttttatgcagtcagtgccagaattggattacatcacctgggggaggcgccttcaggaccaggaaatggtacatggagctttgaggtgaaaactcatcttagaaacccacaaaaagtcattcccccagcctgacatcagggacagaccacacccatggggcagaaaccgggcttggttgttgcagtgggaagagaaggcacgactctggtgcaccgagcacctttcctcgtggctgtttccaggcactgggctggatgtcctcagaaccccctgtcccctgcccactcctcaaacccttactgacccacccctctcgcctggtgctgtcccaggccctgggggtgagggggaggggactccagcgtgggcttgccctccagtgtggtgggagggaaccacgtggccacttggcttagccgtgctcatggtgcagacgtggaacgcggaggcagggagaggctccgtgacgtccccagggccccagaacgaggaaggagcggagttgggattccagcccagttggacgctgaagtccctgttttgtttactgcctcctgttcatggcgtatgaatgtatctgagatgctttgtaaggcataaagtgcaatactagcttagtggctgttcgttcagtgattccttctgttaccaaacaggtggctgagatgagagggcaacccaagcctaacgcccttcagtggccttgcatcagagtactcgtgacaggtacctctccgtggagaggggctgtcctctgcccttgcctgctcctcctattgcaacagtcctgtggactagctcaggctctacaggggctggtgtgtgtgtgtgcgtgtatggtgtatatgtgtctacctacacacaagcacatgtgcacacatgcacacacatgcatgcaagcacacgcacacacacacatgcacacacactcacatggacacacacacacacacatgcacacacatacatgcacacacatgcacatggacacacatacatgcacacacatacatgcaggtgtgcagacttggctccaggcgtgtgtttgatagtattattctatgatatttccctcatctccatagaataccagcttctgaatcctcaatcagcctttactgcaagaagaaaagaaaaacctctctcattccaggtctgtggtgcagatgggaagagtatagtcaaaacccattaaggccttagtcaaatgccagccgaattagaacgcaatgaacgttagacaaaacaacccaactggccaggcgggggaggcgcagagcgtataaatataaagttagatacttataaagaataaagactctaataaaatattttatataaaacttttt

SEQ ID NO: 108142 - DNA, 468 bp, Homo sapiens
atccttgtatggtcgacgggcctgataatgatagagtagaatcataaagtgggggaacttaagataatttttagttcaactcttacgttgtagctgaggcaaagcaaactattccttatacagagctatataactaatgaaaatcagaaatgctttttttttaaacgaaatttgagcgaggtagaaataattatgcaaattgaataccactaaaagaagaatctggctggatgccgtggcccacgcctctaatcccagcgctttaggaggccgaggcgggtggatcacctgaggtcaggagttcaagaccagcctggctaacatggtaaagccctgtttctactaaaaatacaaaaaattacccgggcatggtggtgcgtgcctgtaatctcagctactcgggaggctgaggcaggagaatcgcttgaacccgggaggcggaggttgcagtgagatcgcgccattgca

SEQ ID NO: 108143 - DNA, 301 bp, Homo sapiens
tcaagatgagcatgactagctgggagacacacatggcaaagcatggtcatattagcttccaccatgggtcatgggaggaggacaaaggcaatagttaatgccttcagtggcacctggagaaagagctggctttaagaggctatgacatcttatctgaggctgaaagaatagaatagaaatattcccacagaaagtaatggagaatttccagccaaaaaccacccctgcgaaggcccaggggtaatgctccagggcaaggcgagtgtatgtctgagtttggtaaagggtgaagtctagaggt

SEQ ID NO: 108144 - DNA, 115 bp, Homo sapiens
tatcggcatactcagccctcacgacagcactagtaggtgggtgctgcaagaaccctcactttttaggtgtggaaactgaggcacagtggggttaagcagcttgccgaggctcaca

SEQ ID NO: 108145 - DNA, 344 bp, Homo sapiens
gtgtagaggaatgacataagaattaccattttaggggcttactgtgtgctagtataattttatataataatcacaacttaacaacaaaatagatcatttttattcctattgtacttaggaaaaaactaaggcttatggagctcagagagcttgaccaagatcacagagcaagtagctgacctggattcacaatcaggacaactgaacttaaatactcacggtattaactgctaaaagtgtgatatggttttgttctgtgtccccaccaaatctcgtattgaattgtaatccccagtgtagaaggtggggtcttggaggaggtgattggatcatgggggtggggt

SEQ ID NO: 108146 - DNA, 491 bp, Homo sapiens
tgatggcaccactacattccagcctgggcagcagagcaagaccctgtctcaaaaaaaacccaacaaaacaaaaacaaaaaaacagttcaaagaatactgtttacctaggtttacctattgttaacattttactctatttgctttattatttgctctttctctcataagttgcatacattgtggcattttatccccaaatacttcagtgtggattccctaagagtagggatatatcttgtgtatgtaatgttgttacgttacagttataatttcaataaattaatctctctccccacctgccttttccagaaaactaagacccagagaggttaagtgacttgccctgtggttagataggttccaaatggaaaatccagcctactctgctagtcaggtattagccctggtccctaacatcacaacagaatcttttttttttcccctgacacgccaaattatttagtagtataatacagtaataaaaatttgtg

SEQ ID NO: 108147 - DNA, 215 bp, Homo sapiens
gtctttctcatatacaacatgatgtgatcacatagttgtagcctagctaattttgtagttggttgcacattaagaattcaaaagattctgcctgcacatcactttatctgtgaaaacgaaggacttgggtcacatgatttaaagagctctctctcccttgatattcttgatattcaagtctccatgacaggggctccaatttccacaggaatttt

SEQ ID NO: 108148 - DNA, 183 bp, Homo sapiens
taaatccaatttatacacttgaaaagaatgacatttatgcagtgctttttaatgtaatggatatgtcatttaggtcaaattttttgattaggttgttcaaatcttcatacttaatgattttttgtgtaatttttctaccattactgcaaaaaaatgtattaaatcccatactataattgtgga

SEQ ID NO: 108149 - DNA, 331 bp, Homo sapiens
cataataaatgagaactcatttttgagtagaggtcacaacttataatattaacttgaccagaattatgatggcagtgaatttctgtgaatcactgagtataaggatttccatacactgggtatgggaaaatgcattgttttgatgaatgaagacgccggatgtcacagcagcaatcgtcctctgtaataatcaggccaagccactacctgcaacatactgagcaagtaggtaatcagaaacagtgcgatgcattgaaatgacaagaaggatctgctaaaaatcaggcccaacaacatcacagtcaccgtcttagtctgagataaaatgaaa

SEQ ID NO: 108150 - DNA, 367 bp, Homo sapiens
agccaggctggagtgcagtggtgtaatcctggctcactgcagcctcgaacttccaggctgaagcaatcctcctacctcagcctcctgagtagctgggaccacaggcatgtgccaccatgtattttttgtagagacagggtctcactatgttgccgaggctggtctcgaactcctagacttcagcgacctgcccacctcagcctcccaaaatgctgtgatgataggcatgagccactgggcccagccaaaaaaaccttttattgtaatagggaaaactatgcttctacatagcaatgcccattatgttggaatttcactcacagaataatgtctcaaattacaggaaatctccaggtgaatagcactc

SEQ ID NO: 108151 - DNA, 456 bp, Homo sapiens
ccataacaagctgtcctgaccttctcagtgtgtgacccaggacaccgtggaatctgggaaagccatgatttccacagtatactcctagaaattttaatctcagagaatgatgatagatgtttctggaaaatgagttgtgtttgagaactggattaaacaaaattacagaggcttctttgtggcacttaataatttcccaaaccactaaagagggaagccccagcgctatgagcatacctggcaacagaccacttcctagagaaatgcctccagtgagccagggctacattttgggaagtgactgtatcctacagagtagaaaaatagtcccagcacagggtctcatgcctgtaatcccagcactttgggaggccaaggtgggcagattgcttgagcctaggagttcaagaccagccagggcaacatggcaaaaccctgtcactacagaaaataccc

SEQ ID NO: 108152 - DNA, 1121 bp, Homo sapiens
cgcccctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggtttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcactatctgct

SEQ ID NO: 108153 - DNA, 396 bp, Homo sapiens
tcttctgaatgttcttactgcagcctcacatccatccacggtccgtaggagccatagattgttgctggataacttttcctgcaattttattctatggatttcctatggaaaacagtcttgtgtatctataggtatgaatctaatttttcaaggattaaataaatagtggatggtgtgctggcaagcttttgtttttgacctcatggaaaagttttttggtttttttttttgtttgttttgttttgtttttttaaacttttggctgctttctactttggggttcttaggacaccataaaaataacttcttctccttcccttcatctactgtcaacacagacacagtctttcactttgctctgttctttgcacatcactttattgtgctcatggtctc

SEQ ID NO: 108154 - DNA, 445 bp, Homo sapiens
ttatccaaaagagaaggtaatataagcaaggaaattcaaatatagatgtgaataacatctttccagagagaaaaacaagtaagcaaataattaggatgtgttgtaactaagcaaagaatgtcatcccctttagctacatcgggaacaaaaacatatattctctttaacaaagagatcagaaatagacattttacaaagccttgaacatatcacataagcatcccaaacaatgtggaagatttttaaaatgctattatgtacactataattgaaaaagactttattacatacaaaagataatctccacttgtttttaagtttaggaattataaaaattcataaagacaaaaaagatggattgcagatcatgaaagatacatttctaagaatacatttagaaggacacatttctaagttatgtagcaaatatagctattcaaaagaa

SEQ ID NO: 108155 - DNA, 345 bp, Homo sapiens
caaactagagagcagttccaagtcaacttactggtaacctgttgtataaaaagttactacaaggccaggcatgttggctggtgcctgtaatactagcactttgagaggccgaggagggaggattgcttgagcgtaggggcttgcagtcagcctggtcaacatattgaaaccccatctgtacaaaacaataaaaaaaatttgccaggtatgatggtgtgtgtgtgtggtcccacttagtttgggaggctgaggtgagatgatctcttgagcttgggaggttgaggctgcattgagccgattgcacaactgcattccagcctgggtgacagagtgagaccctgtctc

SEQ ID NO: 108156 - DNA, 467 bp, Homo sapiens
aataaggccggaggaagtgagcatgctgatactaaagaacaggggagagaatactgggtttggttgtgcctggtcactaaaagcaaacttcacccactgagaacctgctagtcaacctcctatgatgttcagaagcctcttgaatgttgataattaatggacagggtgagcttggccaggcaggctggctcatgcctgcagtcccagcactttgggaggtcaaggtgggcagatcgcttgagctcaggagttcaagaccaggctgggccacatggcaaaatgctgtctctggaaaaaatacaaaaaaaattagccagatatggtggcatgcacctgtagtcccagctccttgggagggtgaggcagcaggattgcttaggcccaggaggtcaaggctgcagtgagacaagattgcactgctgcaccccagcatgagtgacagagcgaggtcctgtctcaaaaaaaaa

SEQ ID NO: 108157 - DNA, 204 bp, Homo sapiens
ttccacactgctggctcctcaccaccaaaactcgagggttatctctcagacacccgtcctatcaatgctacgggaagtatccctcaagttactgcctataccacctattgatatatttcatagtatttatcacaatataaaattacttcatcttccccttttaatttaaaatctttttttttctccagactagaatgtaaacct

SEQ ID NO: 108158 - DNA, 3409 bp, Homo sapiens
acaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgattcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatatgttttgaagcaatgaaattaaatatagatactgacattttttacatttccaacaaattgttacttttattcttataaagtgatcatccttttccctattactgaacattcaaccattcattgtaatgatagtaaatacttatttagagtttactattaatagatagtagccactgcctgaagctttgcatcttttaatttagtcctcacactgacactttgaggtatgtactgttatccccaattcccagatgaggaagctgaggcccagcaagttaaggtgggctatcaaagtcatctgggtggcatgtgacaggcctgactctctctacagtggcagacccaggggactagtctccatttttacttgttcttt

SEQ ID NO: 108159 - DNA, 1258 bp, Homo sapiens
ggttacttcttctttttttattttattttaattgagacagcatctcgctctgtcacctgggctggagtgcagtggcacgatctcggctcactgcaacctccgcctcccgggttcaagcgattttcctgcctcagcctcccgagtagctgggattacaggggtgcgctaccatgcccggctaatttttgtatttttagtaaagacggggtttcaccatgttggccaagctggtctcgaactcttgacttcaggtgatccgcccacctcggcctcccaaagtgctgggaccacaggtgtgagccaccgtgcctgacctattttgttacttcttgaagcgggtaacaccactactgtcatccgatggtgagatggggaccaggaaacagtcacaaagaaaacaccgacccctcctccgtggagctcacggtcagctgggtggtcagagttcgaaatgaataacagagtccagtggaagtgtgttatacaaggacttcatctcaggggacaggggagagttctgggaaaggatggatatttaagcttaggccagggtttctcaactgcagcactgctgataatgggctactgcagcactgctgataatgggcctgttcactctcagctgtgggccgtcctgtgcattataggatgctgagcagcatccctggcctcaactcactagatgctacgagcacttttcctctatgagtttgctagggctgccatatcaaagttccaccagctgggtggattaaacagcaaaaatatattgtctcaccgttctggaggccagaagctcgagagcaaggtgttggcagtgttggttccttttgaagcctctccttggtgtgtagatggccatcttctctctatatcttcacatcatcttccctctgtccatgtctgtgtccaaatgtcgtcttcttgtgatagggtttggatttgtgtccccacctaaatctcatgtcaaattgtaatctccagtgttggaggaagggcttggtgggaggtgactggatcatgggggtggacttcccccttgctgttctcttgatagtgagtgagttctcacgagatctggttgtttaaaagtgtgtagcacctcccccttcactctcttcctcctgctccagccatgtagcacgtgcctgcttcccctttgccttccgccatgattgtaagtttctcgagtcctccccagccatgcgtcctgtacaacctgtggaaccaggagccaattaaacctcttttctttata

SEQ ID NO: 108160 - DNA, 1726 bp, Homo sapiens
gcggccgctcccacttcagatgtatgcatttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgattcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatatgttttgaagcaatgaaattaaatatagatactgacattttttacatttccaacaaattgttacttttattcttataaagtgatcatccttttccctattactgaacattcaaccattcattgtaatgatagtaaatacttatttagagtttactattaatagatagtagccactgcctgaagctttgcatcttttaatttagtcctcacactgacactttgaggtatgtactgttatccccaattcccagatgaggaagctgaggcccagcaagttaaggtgggctatcaaagtcatctgggtggcatgtgacaggcctgactctctctacagtggcagacccaggggactagtctccatttttacttgttcttt

SEQ ID NO: 108161 - DNA, 383 bp, Homo sapiens
acaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcaggtgagcccaggcagatcaggtgagcatcagctctggtcagtaaggggagtgtccagtttggaaactgtcttatcagggcaacctattcatacctttgactgagaagc

SEQ ID NO: 108162 - DNA, 2657 bp, Homo sapiens
ctctctccacactggcctctcccctctctccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgattcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatatgttttgaagcaatgaaattaaatatagatactgacattttttacatttccaacaaattgttacttttattcttataaagtgatcatccttttccctattactgaacattcaaccattcattgtaatgatagtaaatacttatttagagtttactattaatagatagtagccactgcctgaagctttgcatcttttaatttagtcctcacactgacactttgaggtatgtactgttatccccaattcccagatgaggaagctgaggcccagcaagttaaggtgggctatcaaagtcatctgggtggcatgtgacaggcctgactctctctacagtggcagacccaggggactagtctccatttttacttgttcttt

SEQ ID NO: 108163 - DNA, 1636 bp, Homo sapiens
agcgggtgggtcgacgagatgagctgtgctgcgcgggtgggcattgtggcttggcacgttggtactgtctcggctggttatgcagggaaaacaccgattgacatcttctataacctggtctccagttgtcctggtaactcagtgcgagctttgcaggatagtggcgtcgtgtcagtcccagcgatgtggcctatttgcatgagatgagcgcatcggaggatcccatgtgggaaactaccgtgatgcttgacccagtggcagtgaccctggcctccatggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgggaacaattcttagatctaagtcttgtgttgctcttcagtatatttttgcgggtaacaccactactgtcatccgatggtgagatggggaccaggaaacagtcacaaagaaaacaccgacccctcctccgtggagctcacggtcagctgggtggtcagagttcgaaatgaataacagagtccagtggaagtgtgttatacaaggacttcatctcaggggacaggggagagttctgggaaaggatggatatttaagcttaggccagggtttctcaactgcagcactgctgataatgggctactgcagcactgctgataatgggcctgttcactctcagctgtgggccgtcctgtgcattataggatgctgagcagcatccctggcctcaactcactagatgctacgagcacttttcctctatgagtttgctagggctgccatatcaaagttccaccagctgggtggattaaacagcaaaaatatattgtctcaccgttctggaggccagaagctcgagagcaaggtgttggcagtgttggttccttttgaagcctctccttggtgtgtagatggccatcttctctctatatcttcacatcatcttccctctgtccatgtctgtgtccaaatgtcgtcttcttgtgatagggtttggatttgtgtccccacctaaatctcatgtcaaattgtaatctccagtgttggaggaagggcttggtgggaggtgactggatcatgggggtggacttcccccttgctgttctcttgatagtgagtgagttctcacgagatctggttgtttaaaagtgtgtagcacctcccccttcactctcttcctcctgctccagccatgtagcacgtgcctgcttcccctttgccttccgccatgattgtaagtttctcgagtcctccccagccatgcgtcctgtacaacctgtggaaccaggagccaattaaacctcttttctttata

SEQ ID NO: 108164 - DNA, 2306 bp, Homo sapiens
acaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgattcataggtatttgctgagatttgctattaggtctggtgtggcttattcttctagctgccaacccaaattaccccttcctccttagaaaagaacctgggttttctgttcagattggcagtgtgcactattaaaaagcttccatcatgcccagccaagttaatttttatatatggagtaagaaaagagtccaacttcattcttttgcatgtgcatatccagttttcccagcaccatttgttgaagactgtcctttccccattgaatggtcttggcacccttgtcaaaattcatttgactataaatgtgaggttttatttctgggctccctcctcgattccattggtctatatgtcttatctttatgccattaccgtattgtgttgattactgtagttttacaataaattttgaaataagaaatgtg

SEQ ID NO: 108165 - DNA, 1560 bp, Homo sapiens
cacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgggaacaattcttagatctaagtcttgtgttgctcttcagtatatttttgcgggtaacaccactactgtcatccgatggtgagatggggaccaggaaacagtcacaaagaaaacaccgacccctcctccgtggagctcacggtcagctgggtggtcagagttcgaaatgaataacagagtccagtggaagtgtgttatacaaggacttcatctcaggggacaggggagagttctgggaaaggatggatatttaagcttaggccagggtttctcaactgcagcactgctgataatgggctactgcagcactgctgataatgggcctgttcactctcagctgtgggccgtcctgtgcattataggatgctgagcagcatccctggcctcaactcactagatgctacgagcacttttcctctatgagtttgctagggctgccatatcaaagttccaccagctgggtggattaaacagcaaaaatatattgtctcaccgttctggaggccagaagctcgagagcaaggtgttggcagtgttggttccttttgaagcctctccttggtgtgtagatggccatcttctctctatatcttcacatcatcttccctctgtccatgtctgtgtccaaatgtcgtcttcttgtgatagggtttggatttgtgtccccacctaaatctcatgtcaaattgtaatctccagtgttggaggaagggcttggtgggaggtgactggatcatgggggtggacttcccccttgctgttctcttgatagtgagtgagttctcacgagatctggttgtttaaaagtgtgtagcacctcccccttcactctcttcctcctgctccagccatgtagcacgtgcctgcttcccctttgccttccgccatgattgtaagtttctcgagtcctccccagccatgcgtcctgtacaacctgtggaaccaggagccaattaaacctcttttctttata

SEQ ID NO: 108166 - DNA, 521 bp, Homo sapiens
cacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgctgcctctcctgtccctgctg

SEQ ID NO: 108167 - DNA, 285 bp, Homo sapiens
cctctgccatctgtttcctcccaggaccctggctgatgcaccaggagcttgaggagatggagtggtgttcagagcctcttccctttagagttcagagcaaccaaatgggcatcatgctgaacgtgggagaaacaaaagaatctcttgcacttggactcttttctgaaaatttgccccctgcaaagcaaaatggtggtggtgatgatgacggtgatgatggtagtggccatttctttgcctacccactgtggccttgttgtgaagaactttgatgccctgttgtat

SEQ ID NO: 108168 - DNA, 569 bp, Homo sapiens
agctgggattacaggcacccgccaccacacccggttaattttttttgtattttttagtagagacggggtttcaccatgttggccaggctagtctcaaactcctgacctcaggtgatccacccaccttggcctcccaaagtgctgggattacaggcatgagccactgcgcccagctgagaatttttaaaaacagactacaaagtgcagcaaatacaataaacacagtaaaaatctaatatgatggagttgagaccaaacataccagtcataccagtaggcaactcttctatcaaaagaaaatgatgttcaaattggctaacaaagcaacactagttttgcactaggtacaaagaaatacaaagtgatttaatgtgaaaaccaagagacaggcaaaggaaccccagagaggtggtatggtgcatgtgtactgcacatgtgcatgtatagctatctttatcagggttatacttatttataagaagtacttttatgtttttaactgcttatttcttcatctgttatattcaggttcttcagtgtgtccagcagtttctgtggggtgaggatgt

SEQ ID NO: 108169 - DNA, 432 bp, Homo sapiens
  misc_feature (8)..(8): n is a, c, g, or t
  misc_feature (33)..(33): n is a, c, g, or t
gcggccgnctactactactaaattcgcggccgntcgaccgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108170 - DNA, 547 bp, Homo sapiens
aaaaattaggctagagggccgcggtaaatcggagagggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108171 - DNA, 549 bp, Homo sapiens
  misc_feature (36)..(36): n is a, c, g, or t
caatagctaggtcgaggccgggtgttaattcggccnaggctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108172 - DNA, 589 bp, Homo sapiens
caacgaatggtcctcagctactcgggaggctgaggcaacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaggaccatcgttgcaacgatggtcctcagcttctcga

SEQ ID NO: 108173 - DNA, 505 bp, Homo sapiens
cttccaaccggttgcggccggcttctaaaaattaatggaaccccggggctgcaggaaatcggcaacgaacctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108174 - DNA, 258 bp, Homo sapiens
  misc_feature (8)..(8): n is a, c, g, or t
  misc_feature (33)..(33): n is a, c, g, or t
gcggccgnctactactactaaattcgcggccgntcgaccattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108175 - DNA, 221 bp, Homo sapiens
  misc_feature (45)..(45): n is a, c, g, or t
aattcgcggccgcgtcgacacggtgcgagaagacgacagaagggnaggcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108176 - DNA, 233 bp, Homo sapiens
cgagctcggtaccccaacgatggtcctgcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaggaccatcgttgggatcctctagatcaactcg

SEQ ID NO: 108177 - DNA, 690 bp, Homo sapiens
  misc_feature (573)..(573): n is a, c, g, or t
aagaggctacgtagaggcgactaggcccctttcctcagcttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaatanatataatataattaaataaaaattttttaattaatacaaaaataggaggggaacaaagaattaaaaattaaaaagagaaggggcccatattcggggccaactgggccaatatccccc

SEQ ID NO: 108178 - DNA, 409 bp, Homo sapiens
gtgcatatgctaggactaagctttggccagtatgactcacatggtaacagacagggctgctggggccctgtctgtcaccagaaaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108179 - DNA, 577 bp, Homo sapiens
ctatgcacatcctcctgtatactttagaagtctacatgtttggtacacatgcttatttttccactgttgaatccatggatgtggaactcactgtatatagtgttaggggttgatcactgtaacctggaatgggggatacttttcgtttttggctgcgtgagtgcttaacaaggacagaactgggcgtttacctatgcatgcacatgtattgcaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaaaaaaacaaaaacaaaaaaaaaaaaaaaaagaaacaaaaaaaaaaaaaaaaaaaaaaagagaggggggggggg

SEQ ID NO: 108180 - DNA, 848 bp, Homo sapiens
aagaggctacgtagaggcgactaggcccctttcctcagcttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaacaaaaaaaaaaaggggggccgcccttttttttttttttaaggatgaaaacgcgcaactctacctcttgcgggtccacaaacacccgctcgccggaacgaggccgcgggggcgcgtgtcattattgggttcccccccaaccccgaggaagggagcttaggttcccaaataaagggcctgagggggggggtacccggccttgggcgtggagctccggtgggagggagaccccgtattcctccaggagtgggagcgccgtcccacgagggtcttgccccagagcccctccggtcccccta

SEQ ID NO: 108181 - DNA, 451 bp, Homo sapiens
ctatgcacatcctcctgtatactttagaagtctacatgtttggtacacatgcttatttttccactgttgaatccatggatgtggaactcactgtatatagtgttaggggttgatcactgtaacctggaatgggggatacttttcgtttttggctgcgtgagtgcttaacaaggacagaactgggcgtttacctatgcatgcacatgtattgcaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108182 - DNA, 549 bp, Homo sapiens
aagaggctacgtagaggcgactaggcccctttcctcagcttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108183 - DNA, 299 bp, Homo sapiens
  misc_feature (23)..(23): n is a, c, g, or t
  misc_feature (243)..(243): n is a, c, g, or t
accggcgctgactaccggcgtantgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagntgaggagaagaaagtggaagcaataagaagagccgagtgggtcctctagatcaccg

SEQ ID NO: 108184 - DNA, 207 bp, Homo sapiens
tcgtgccgaattcggcacgagcggcacgagcacgcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108185 - DNA, 463 bp, Homo sapiens
agactagttctctctctctttccttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108186 - DNA, 148 bp, Homo sapiens
tctagaggatcccgtaagagaccaggtagctgaggagaagaaagtggaagcaaagaaagaagaatccgaggagtctgatgatgacatgggctttggtctttttgactaaacctcttttataacatgttcaataaaaagctgaacttta

SEQ ID NO: 108187 - DNA, 177 bp, Homo sapiens
cgagtgatcccttatttccttctttattgcttcctgccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108188 - DNA, 682 bp, Homo sapiens
atattacatacgctacgttttgatggattgacgtttttatttgttgtaggaggataagatcaatgccctcattaaagcagccggtgtaaatgttgagcctttttggcctggcttgtttgcaaagggtaaggtgatggtggcaaagtgattgtggtaaggcctgctgatttacgagggcagttgtacatgctaaagtacccccagcggtgccataacgccccacatgccgctggatctcctaggtgtttttcgttgcatgtatatctctaggagctaataagatttcagcttgtcaagtcttacgtttccttatcagactctggtttcccttttgctctgaaaccatggttaaaaaaaatgtgaatcaggtcatttattcccaaaaagggtcactcgggagataggtactacgcatgttaagttgcaagcaaattctttttctttttcttttttttttcttgagacggagtcacccaggctggagtgcagtggtgcgatctcagctcactgcaagctccgcctcccgggttcacgccattatcctgcctcagcctcccgagcagctgggactacaggcgtgcgccaccatgcctggctaatttttgtgtgtgtgtttagtagtgacggggtttcaccatgttagccaggatggtctcgatctcctgacctcgtgatccccccg

SEQ ID NO: 108189 - DNA, 582 bp, Homo sapiens
tccctggtggtctagtggttaggatttggcgttctcaccgccgcggcccgggttcgattcccggtcagggaactcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108190 - DNA, 982 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaacaaaaacaaaaacaactctatcaccttacctacccactactaccaatcttacaaaaaaaaaaaactcggggggggccccggcccccatttggccttatgggggcggattacaaataacgggccggggtttaaaaccggcgggcatgggaaaaccgtggggttcccaccttaatccgcttgggaaaaatcccctttttgccggtgtgggaatacca

SEQ ID NO: 108191 - DNA, 727 bp, Homo sapiens
  misc_feature (651)..(651): n is a, c, g, or t
  misc_feature (679)..(679): n is a, c, g, or t
aaaaattaggctagagggccgcggtaaatcggagagggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaaaaaataatatataaataatttattatttatataaaataatattttttatntgggtgtataaaaatatttattttaatnaagggcccaaattgagcgctatttgcaaatatcccctttttggggggg

SEQ ID NO: 108192 - DNA, 851 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaaaaaaaaaaaaaaaaaaaaaaaaaaaaaaagagaggggggggggg

SEQ ID NO: 108193 - DNA, 1174 bp, Homo sapiens
  misc_feature (977)..(977): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaagggggggtttttggggggggggaaaaaggggttgaatggcgcactgggccatacgcggtttcccggaccccacgtttcttgtgtgtcaccagcgggggcaaaactggcggggcgcccccccatatgggggaggcgcgaattaaaatttcccgaaaaagcccggggttacccgggttaggtgtctgcggccagacacngggacaaccgacacacgacacaacaccaacacagcacgcgacgggaaccacacagagtgagccgagcaaaaacgacgccaccaacgacacgagcaacagcacaaacgaaacacacacaacacactagacaacgtcacagaccacacacatacgaacacgacagccagagccggacgcacatatcagtcagacggcgt

SEQ ID NO: 108194 - DNA, 1265 bp, Homo sapiens
  misc_feature (929)..(929): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaacaaacaaaaaaaacacaaaaaaacaaaaaaaaaaaaaaaaaaaggggggggggggggggggggccaaaaaaattcccccgggggggccaccacaaaggttatacagcagacaccccgtattttagtaaaaaaaggcgggcgccccaanaagaggggcggcgcctcataaaaagaacaaggacgcgggcgcgcggcagtaaaaccacacgcgcggggagaggacacaacagcgtagagagggacatcgaaggagggggcgcaccccccaaccgcggcgggggcggcgggcacgatatgtcggaccccaacaccaccacgaaggagtataaagccccccgagaggaaagaaatacacacagagaagaggggggacagggggggacaacccacacaggacaatatcacgcgcgcgaagaaaaattgcacccacacaccgactattatcagaagacaagaccgcgcggggggcgaaaaaacatctaag

SEQ ID NO: 108195 - DNA, 1028 bp, Homo sapiens
  misc_feature (895)..(895): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaggggcccgccccagggggttgccagggcctcaggacttgcttgggccccaaggaattgcagaggcatcctgggacctcatgggcccttggggacctcaaggggccacctggaccncaagggtagttctggtcctcaaggtcatatgggtcctcagggtccacctggcccagaggtcacttaggccccaaggccgctgggcctcaggtacttggcccagggccccggaccaggttgcggccctgcccag

SEQ ID NO: 108196 - DNA, 894 bp, Homo sapiens
  misc_feature (777)..(777): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaatanatataatataattaaataaaaattttttaattaatacaaaaataggaggggaacaaagaattaaaaattaaaaagagaaggggcccatattcggggccaactgggccaatatccccc

SEQ ID NO: 108197 - DNA, 1405 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaactgctgttggtcttgtccatagttttggaatgtgctctgcaaaaatggtctgttttgtaatgttggctttcagcctattctgccatgacacaggctggattttccctgccaccattgccggatgtgagatttagacaatcctgatgctaacaagaaggcacctcatggtacagtgttgaaaactgcactggggtggcaggaggaaggatcagagcagatgctttgtccaggttacctgtgtaaacttgatgattataaggtgtgtcccctacactgggggtggagggtaatacagaccagctttagaaagcctcctgggtatttaccctatacaaccctgcctaagaacgaactttgacgtatgctgaatgttgactgctacatcccaaggttgtaaaaaaacaagacttagctatgtaatgtctcaccaaatgtttgggagttttatgataacactgaaggagtgcagaaagtttacttaatagtttattaaggtctccagttacacaaagtggaaaaaaaaaagattcaaacctgtgttccaaaaactaagagctttttttgtttgccaattaataataccatgaatggaattttcaacttttcaggcttggatttatataataaaccgtgggtattgtgtgttcagag

SEQ ID NO: 108198 - DNA, 1052 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaacaaaaaaaaaaaggggggccgcccttttttttttttttaaggatgaaaacgcgcaactctacctcttgcgggtccacaaacacccgctcgccggaacgaggccgcgggggcgcgtgtcattattgggttcccccccaaccccgaggaagggagcttaggttcccaaataaagggcctgagggggggggtacccggccttgggcgtggagctccggtgggagggagaccccgtattcctccaggagtgggagcgccgtcccacgagggtcttgccccagagcccctccggtcccccta

SEQ ID NO: 108199 - DNA, 1218 bp, Homo sapiens
  misc_feature (882)..(882): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaacaaacaaaaaaaacacaaaaaaacaaaaaaaaaagggggggggccaaaaaaattcccccgggggggccaccacaaaggttatacagcagacaccccgtattttagtaaaaaaaggcgggcgccccaanaagaggggcggcgcctcataaaaagaacaaggacgcgggcgcgcggcagtaaaaccacacgcgcggggagaggacacaacagcgtagagagggacatcgaaggagggggcgcaccccccaaccgcggcgggggcggcgggcacgatatgtcggaccccaacaccaccacgaaggagtataaagccccccgagaggaaagaaatacacacagagaagaggggggacagggggggacaacccacacaggacaatatcacgcgcgcgaagaaaaattgcacccacacaccgactattatcagaagacaagaccgcgcggggggcgaaaaaacatctaag

SEQ ID NO: 108200 - DNA, 856 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaacaaacaaaaaaaacacaaaaaaacaaaaaaaaaaaaaaaaaaaaaaaaaaaaaaaaaaaaaaaaaaaaaaaaaaaaaaaaaaaaaaagagaggggggggggg

SEQ ID NO: 108201 - DNA, 906 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttataccgccgccccccgcccacaagcgcccgctcacggaggggccggacccacttcggcgtaaattgagtcgtatacaagtcaggggcgacggtttacaacgtcgtagcgtgtaaccctcgggttccctaatcgcctttgaccaatccctttgct

SEQ ID NO: 108202 - DNA, 1277 bp, Homo sapiens
  misc_feature (941)..(941): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaaaaaaaaaaaaaaaaacaaaaaaaaaaaaaggggggggggggggggggggccaaaaaaattcccccgggggggccaccacaaaggttatacagcagacaccccgtattttagtaaaaaaaggcgggcgccccaanaagaggggcggcgcctcataaaaagaacaaggacgcgggcgcgcggcagtaaaaccacacgcgcggggagaggacacaacagcgtagagagggacatcgaaggagggggcgcaccccccaaccgcggcgggggcggcgggcacgatatgtcggaccccaacaccaccacgaaggagtataaagccccccgagaggaaagaaatacacacagagaagaggggggacagggggggacaacccacacaggacaatatcacgcgcgcgaagaaaaattgcacccacacaccgactattatcagaagacaagaccgcgcggggggcgaaaaaacatctaag

SEQ ID NO: 108203 - DNA, 934 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaacaaaaaaaaaaaaaaaaaaaaaaaaaccgggggggatataaatgggggggggggaaaaaggggtttaaaaggggcggggcaaaggggttttcggcacccgtttttttacaggggggaaaagggggccccaatgggggggaataatggaagcggggtaccggaa

SEQ ID NO: 108204 - DNA, 1210 bp, Homo sapiens
  misc_feature (874)..(874): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaagggggggggccaaaaaaattcccccgggggggccaccacaaaggttatacagcagacaccccgtattttagtaaaaaaaggcgggcgccccaanaagaggggcggcgcctcataaaaagaacaaggacgcgggcgcgcggcagtaaaaccacacgcgcggggagaggacacaacagcgtagagagggacatcgaaggagggggcgcaccccccaaccgcggcgggggcggcgggcacgatatgtcggaccccaacaccaccacgaaggagtataaagccccccgagaggaaagaaatacacacagagaagaggggggacagggggggacaacccacacaggacaatatcacgcgcgcgaagaaaaattgcacccacacaccgactattatcagaagacaagaccgcgcggggggcgaaaaaacatctaag

SEQ ID NO: 108205 - DNA, 1149 bp, Homo sapiens
  misc_feature (761)..(761): n is a, c, g, or t
  misc_feature (764)..(764): n is a, c, g, or t
  misc_feature (768)..(768): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttataaacaancanaccnaaaaacccaacccacacccaaccccaccccctccccacccaccacacacacactaccccaaccaacaccaccaaccccccccacccacaccaccccctccccacaccacacacacccccacacccccccccccaccccatctccctcaccccctccaccgcagtgacagcggtacagcagtcgtagagacctgccgcgggagcccggcgccacacaagccatcaggatagcgcgaccgacccgcagtacagagtgcgacgggcctcgtaaacgcgaaggaaggcactcgccatccagggagccacattgacgcgcagtgcaggcccccatgttacgaccggcacacacgggggggacagaggagacagccctcaaaccgct

SEQ ID NO: 108206 - DNA, 879 bp, Homo sapiens
  misc_feature (879)..(879): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaagcgagactgggaaaccctgcgtacccacctaatcgcttggggacatcccctttgccgttgcgtaaacaacagcccgaacgacgcctttcaacattgccacccgatggcaatgcattttan

SEQ ID NO: 108207 - DNA, 789 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaggaccatcgttgcaacgatggtcctcagcttctcga

SEQ ID NO: 108208 - DNA, 1031 bp, Homo sapiens
  misc_feature (774)..(774): n is a, c, g, or t
  misc_feature (827)..(828): n is a, c, g, or t
  misc_feature (844)..(844): n is a, c, g, or t
  misc_feature (846)..(846): n is a, c, g, or t
  misc_feature (852)..(852): n is a, c, g, or t
  misc_feature (855)..(855): n is a, c, g, or t
  misc_feature (864)..(865): n is a, c, g, or t
  misc_feature (873)..(875): n is a, c, g, or t
  misc_feature (889)..(889): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttacctataaaaaaaaaaaaaaanaaaaaaaaaaaaaaaaaaaaaaaaacctcgggggggggcccgggccccaattnnccctataggggggcgntnacaatncanggggcgggnnttacaaannnggggactgggaaanccctggggttccacaattattggccttgaaaaaatccccctttgcaagctggggtaaagcaaaaaggcccgaccgtcgccctccaaacatttgcgaccctgaaggcaatgcaaattgtagcggtatattttgggggttttgg

SEQ ID NO: 108209 - DNA, 804 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttattttaaaagaaacgcgtatactatatatagatatttcttttaaacggggcc

SEQ ID NO: 108210 - DNA, 785 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttacgtgccgctcgtgccgaattcctgcagcccgg

SEQ ID NO: 108211 - DNA, 480 bp, Homo sapiens
  misc_feature (8)..(8): n is a, c, g, or t
  misc_feature (33)..(33): n is a, c, g, or t
gcggccgnctactactactaaattcgcggccgntcgacccttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108212 - DNA, 748 bp, Homo sapiens
  misc_feature (740)..(740): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgacaaaaagaccaaagcccatggtcgacccgnccgcgaat

SEQ ID NO: 108213 - DNA, 722 bp, Homo sapiens
tccctggtggtctagtggttaggatttggcgttctcaccgccgcggcccgggttcgattcccggtcagggaactcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccaggtaggaaacatggagtttttagtattgggaggagtgtagagatttttttaaaaatagtattatagacaaaattgccattaatttttcacaagtatatgaagtatggaaatcctaacacctgattgactttttttttctagctgaggagaagaaagtggaagcaaagaaagaagaatccgaggagtctgatgatgacatgggctttggtctttttgactaaacctcttttataacatgttcaataaaaagctgaacttta

SEQ ID NO: 108214 - DNA, 823 bp, Homo sapiens
  misc_feature (781)..(781): n is a, c, g, or t
tccctggtggtctagtggttaggatttggcgttctcaccgccgcggcccgggttcgattcccggtcagggaactcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccaggtaggaaacatggagtttttagtattgggaggagtgtagagatttttttaaaaatagtattatagacaaaattgccattaatttttcacaagtatatgaagtatggaaatcctaacacctgattgactttttttttctagctgaggagaagaaagtggaagcaaagaaagaagaatccgaggagtctgatgatgacatgggctttggtctttttgactaaacctcttttataacatgttcaataaaaagctgaactttaaaaaaatgcacccgcttacagtgattaaaaacacacacacacacacaccacctacattntgtggggtctaatggaatagtggggaccagaactggatcttg

SEQ ID NO: 108215 - DNA, 483 bp, Homo sapiens
gcctactactactaaatttccccccggtgtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccactgaggagaagaaagtggaagcaaagaaagaagaatccgaggagtctgatgatgacatgggctttggtctttttgactaaacctcttttataacatgttcaataaaaagctgaacttta

SEQ ID NO: 108216 - DNA, 676 bp, Homo sapiens
  misc_feature (545)..(546): n is a, c, g, or t
  misc_feature (562)..(562): n is a, c, g, or t
  misc_feature (564)..(564): n is a, c, g, or t
  misc_feature (570)..(570): n is a, c, g, or t
  misc_feature (573)..(573): n is a, c, g, or t
  misc_feature (582)..(583): n is a, c, g, or t
  misc_feature (591)..(593): n is a, c, g, or t
  misc_feature (607)..(607): n is a, c, g, or t
gcctactactactaaatttccccccggtgtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccactgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaacatgcgggccgcaatttgagcctacttggcaattnnccctataggggggcgntnacaatncanggggcgggnnttacaaannnggggactgggaaanccctgcgttacccacataaattgcttggggaaaacccccttttccgtggcggcggcccccccccccccc

SEQ ID NO: 108217 - DNA, 950 bp, Homo sapiens
  misc_feature (614)..(614): n is a, c, g, or t
tggctagtaagctgggtgtgaatcggcgaaggcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaaaaaaaaaaaaaaaaacaaaaaaaaaaaaaggggggggggggggggggggccaaaaaaattcccccgggggggccaccacaaaggttatacagcagacaccccgtattttagtaaaaaaaggcgggcgccccaanaagaggggcggcgcctcataaaaagaacaaggacgcgggcgcgcggcagtaaaaccacacgcgcggggagaggacacaacagcgtagagagggacatcgaaggagggggcgcaccccccaaccgcggcgggggcggcgggcacgatatgtcggaccccaacaccaccacgaaggagtataaagccccccgagaggaaagaaatacacacagagaagaggggggacagggggggacaacccacacaggacaatatcacgcgcgcgaagaaaaattgcacccacacaccgactattatcagaagacaagaccgcgcggggggcgaaaaaacatctaag

SEQ ID NO: 108218 - DNA, 549 bp, Homo sapiens
  misc_feature (544)..(545): n is a, c, g, or t
tccctggtggtctagtggttaggatttggcgttctcaccgccgcggcccgggttcgattcccggtcagggaactcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaagggttgtgcaaggcctgcctagtcttctttttttttctttattttttatgttctgaaggattaacccggtaaggagtcggatgatgcatggagaatcatttcgagcctgctgtccctatgcgatgccacgcgccgcgctcggaacgcgcaacagcaatcgagccgactgacttaaacacgggaaactcgtttctcttttnntccc

SEQ ID NO: 108219 - DNA, 603 bp, Homo sapiens
cttccaaccggttgcggccggcttctaaaaattaatggaaccccggggctgcaggaaatcggcaacgaacctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaaaaaaaaaaaaaaaaaaaaaaaaaaaaaaagagaggggggggggg

SEQ ID NO: 108220 - DNA, 388 bp, Homo sapiens
ggaggcgttaattggcccggaggcgttgcatggcctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacgaggataagatcaatgccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108221 - DNA, 773 bp, Homo sapiens
ggaggcgttaattggcccggaggcgttgcatggcctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacgggtgagtgcgggcgcgggccggcggccgggctgcctgtgggcggtgactttcggctctccatgcggttcccggctccaggccgttcgactgagcacttccggccggggccaggccgcgaacacaggccgcatagggcgggcgctcctcggggctggggcctctctccgggcaggtcctgggcccccgggaccacgtgcgggcccagcgggcatggagtgcgcttgaggctgggcgctccggctccaagagccttcgtgtagaaaagctcttccgcagtgcttgggcaccctgacccgtgcctcgtctctctcagggacacttactcggacctctttcggtgtaattgccttgaattcccccggtcgtggaggaaggcgcccgagctcggctccacctcccaggtcttgtaacttaaaaatagccgcgtgactcaggcaagtcccagcccgtgaaacagcagtgatgggctcgcctcattgcagggcgcctggcacacatctcttttgcttgtgatagaatacctcgagctggttaaacatg

SEQ ID NO: 108222 - DNA, 320 bp, Homo sapiens
  misc_feature (233)..(233): n is a, c, g, or t
  misc_feature (241)..(241): n is a, c, g, or t
  misc_feature (283)..(283): n is a, c, g, or t
ggaggcgttaattggcccggaggcgttgcatggcctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacgntttccaancccggcaagggactacagatcaatgccctcattaaagcagcncggtggtttaaaacaaacttgggcttttgcgacgccc

SEQ ID NO: 108223 - DNA, 631 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcatggtgcacaagccgccaagccgcgccctcggagccggggcgggcggagatgggcggactgaggagccccatgggggaccccctggtgcataccgaaggtacagcgccggggaactaacgtggggacacccaattcgtgggcagagagcaagcagggtggacaggtcacaacgggagggactaaagaccaatgcccctcagtaaacgagcgggcgtaacacgtagcaggccctctggggccgggcacgggagccaagggccggcaaggtca

SEQ ID NO: 108224 - DNA, 753 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108225 - DNA, 359 bp, Homo sapiens
  misc_feature (45)..(45): n is a, c, g, or t
aattcgcggccgcgtcgacacggtgcgagaagacgacagaagggnaggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108226 - DNA, 380 bp, Homo sapiens
cactaggtaatattactagtgaattcactagtaattcattctgcacgacgatggaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108227 - DNA, 933 bp, Homo sapiens
  misc_feature (857)..(857): n is a, c, g, or t
  misc_feature (885)..(885): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaaaaaataatatataaataatttattatttatataaaataatattttttatntgggtgtataaaaatatttattttaatnaagggcccaaattgagcgctatttgcaaatatcccctttttggggggg

SEQ ID NO: 108228 - DNA, 1238 bp, Homo sapiens
  misc_feature (770)..(770): n is a, c, g, or t
  misc_feature (772)..(772): n is a, c, g, or t
  misc_feature (774)..(775): n is a, c, g, or t
  misc_feature (777)..(777): n is a, c, g, or t
  misc_feature (782)..(782): n is a, c, g, or t
  misc_feature (785)..(785): n is a, c, g, or t
  misc_feature (902)..(902): n is a, c, g, or t
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaananannanaaaanaanaaaaaaaaaaaaaaaaaacaaaagggggggggccaaaaaaattcccccgggggggccaccacaaaggttatacagcagacaccccgtattttagtaaaaaaaggcgggcgccccaanaagaggggcggcgcctcataaaaagaacaaggacgcgggcgcgcggcagtaaaaccacacgcgcggggagaggacacaacagcgtagagagggacatcgaaggagggggcgcaccccccaaccgcggcgggggcggcgggcacgatatgtcggaccccaacaccaccacgaaggagtataaagccccccgagaggaaagaaatacacacagagaagaggggggacagggggggacaacccacacaggacaatatcacgcgcgcgaagaaaaattgcacccacacaccgactattatcagaagacaagaccgcgcggggggcgaaaaaacatctaag

SEQ ID NO: 108229 - DNA, 1148 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttagaccatcaacgatggtcctcagcttctacctagaagctgatggacaacagatttaaatccatattctttttttaagcagggctcagaagacctactcttgtctaaggaaactatgggttccacatctattttgcacattccccaacacacacacacacacacacacacacacacacacacaaatagagagcatcaagagtgctaattgtatctaagcgcgagtgctaagggtgggatcccagagccactcagaattatactaaacttagagcagggatcgagtggagggtatactaaataaatatatagtgaacaaaaatatatattcctaaagtcataccctatgctcagttggtgggaatttttttctctctctctttaaaaaacaagtctca

SEQ ID NO: 108230 - DNA, 519 bp, Homo sapiens
  misc_feature (15)..(15): n is a, c, g, or t
  misc_feature (20)..(20): n is a, c, g, or t
  misc_feature (22)..(22): n is a, c, g, or t
  misc_feature (51)..(51): n is a, c, g, or t
  misc_feature (58)..(58): n is a, c, g, or t
acaaaagatggagcncaccngnggtgcggccgcccttagaacgtagtggtnccccggnctgcaggaattcggcacgatcttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108231 - DNA, 741 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgacggataatgtcaaacgctgcgtctttgtttt

SEQ ID NO: 108232 - DNA, 3050 bp, Homo sapiens
atgggaaatgctttcgccacagcctgttcagagaaacatgatccctgacccggaaatggaggaggagacagagttccttgagctcggaaccaggatatcaagaccaaatggactactgtcagaggatgtaggaatggacatcccctttgaagagggcgtgctgagtccccgtgctgcagacatgaggcctgaacctcctaattctctggatcttaatgacactcatcctcggagaccacgatggtcctcagctgccgccaaggtgctcggtccttccgaggaagctaaggctgcgttggggtgaggccctcacttcatccggcgactagcaccgcgtccggcagcgccagccctacactctcttcatctctcgacctcgtgatgggccgccgcggcgggcgcgggcccggagatggtccgcgggcaggtgttcgacgtggggccgcgctacaccaacctctcgtacatcggcgagggcgcctacggcatggtgtgctctgcttatgataatgtcaacaaagttcgagtagctatcaagaaaatcagcccctttgagcaccagacctactgccagagaaccctgagggagataaaaatcttactgcgcttcagacatgagaacatcattggaatcaatgacattattcgagcaccaaccatcgagcaaatgaaagatgtatatatagtacaggacctcatggaaacagatctttacaagctcttgaagacacaacacctcagcaatgaccatatctgctattttctctaccagatcctcagagggttaaaatatatccattcagctaacgttctgcaccgtgacctcaagccttccaacctgctgctcaacaccacctgtgatctcaagatctgtgactttggcctggcccgtgttgcagatccagaccatgatcacacagggttcctgacagaatatgtggccacacgttggtacagggctccagaaattatgttgaattccaagggctacaccaagtccattgatatttggtctgtaggctgcattctggcagaaatgctttctaacaggcccatctttccagggaagcattatcttgaccagctgaaccacattttgggtattcttggatccccatcacaagaagacctgaattgtataataaatttaaaagctaggaactatttgctttctcttccacacaaaaataaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaaatttgtcaggacaagggctcagaggactggacgtgctcagacatcggtgttcttcttcccagttcttgacccctggtcctgtctccagcccgtcttggcttatccgctttgactcctttgagccgtttggaggggcggtttctggtagttgtggcttttatgctttcaaagaatttcttcagtccagagaattcctcctggcagccctgtgtgtgtcacccattggtgacctgcggcagtatgtacttcagtgcaccttactgcttactgttgctttagtcactaattgctttctggtttgaaagatgcagtggttcctccctctcctgaatccttttctacatgatgccctgctgaccatgcagccgcaccagagagagattcttccccaattggctctagtcactggcatctcactttatgatagggaaggctactacctagggcactttaagtcagtgacagccccttatttgcacttcaccttttgaccataactgtttccccagagcaggagcttgtggaaataccttggctgatgttgcagcctgcagcaagtgcttccgtctccggaatccttggggagcacttgtccacgtcttttctcatatcatggtagtcactaacatatataaggtatgtgctattggcccagcttttagaaaatgcagtcatttttctaaataaaaaaggaagtactgcacccagcagtgtcactctgtagttactgtggtcacttgtaccatatagaggtgtaacacttgtcaagaagcgttatgtgcagtacttaatgtttgtaagacttacaaaaaaagatttaaagtggcagcttcactcgacatttggtgagagaagtacaaaggttgcagtgctgagctgtgggcggtttctggggatgtcccagggtggaactccacatgctggtgcatatacgcccttgagctacttcaaatgtggtttatacctcgcagatacaagaatctttatgaatatacaattctttttccttctacagcttagctccgtcttttcaaccacgaacatttaaaacccgacctactagcactgttctgtcctcaagtactcaaatatttctgatactgctgagtcagactgtcagaaaaagctagcactaactcgtgtttggagctctatccatattttactgatctctttaagtatttgttcctgccactgtgtactgtggagttgactcggtgttctgtcccagtgcggtgcctcctcttgacttccccactgctctctgtggtgagaaatttgccttgttcaataattactgtacccctcgcatgactgttacagctttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacacgaatggagaatgggttatataaagactgcctgctattgacagaaatgcatttgtaattcatgaaaataaatgtacatcttctatcttc

SEQ ID NO: 108233 - DNA, 840 bp, Homo sapiens
  misc_feature (707)..(707): n is a, c, g, or t
tacacgccccagcgcagaccgcaaccaagtaggcctaggtacgaggcccgtttatttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaggggcccgccccagggggttgccagggcctcaggacttgcttgggccccaaggaattgcagaggcatcctgggacctcatgggcccttggggacctcaaggggccacctggaccncaagggtagttctggtcctcaaggtcatatgggtcctcagggtccacctggcccagaggtcacttaggccccaaggccgctgggcctcaggtacttggcccagggccccggaccaggttgcggccctgcccag

SEQ ID NO: 108234 - DNA, 544 bp, Homo sapiens
ggaggcgttaattggcccggaggcgttgcatggcctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108235 - DNA, 531 bp, Homo sapiens
tatcagtcgtcctatagcgctatcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108236 - DNA, 769 bp, Homo sapiens
  misc_feature (638)..(639): n is a, c, g, or t
  misc_feature (655)..(655): n is a, c, g, or t
  misc_feature (657)..(657): n is a, c, g, or t
  misc_feature (663)..(663): n is a, c, g, or t
  misc_feature (666)..(666): n is a, c, g, or t
  misc_feature (675)..(676): n is a, c, g, or t
  misc_feature (684)..(686): n is a, c, g, or t
  misc_feature (700)..(700): n is a, c, g, or t
aagaggctacgtagaggcgactaggcccctttcctcagcttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaaaaaaaaaaaaaaaaaaaaaaaaaaaaaaaaaaaaaaaaaaaaaaaaaacatgcgggccgcaatttgagcctacttggcaattnnccctataggggggcgntnacaatncanggggcgggnnttacaaannnggggactgggaaanccctgcgttacccacataaattgcttggggaaaacccccttttccgtggcggcggcccccccccccccc

SEQ ID NO: 108237 - DNA, 657 bp, Homo sapiens
  misc_feature (657)..(657): n is a, c, g, or t
aattacgggctaggtagcgaggtcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaaaaagcgagactgggaaaccctgcgtacccacctaatcgcttggggacatcccctttgccgttgcgtaaacaacagcccgaacgacgcctttcaacattgccacccgatggcaatgcattttan

SEQ ID NO: 108238 - DNA, 763 bp, Homo sapiens
  misc_feature (36)..(36): n is a, c, g, or t
caatagctaggtcgaggccgggtgttaattcggccnaggctcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaacaaacaaaaaaaacacaaaaaaacaaaaaaaaaacaaacacacctccgaggacaatgacttcctcgctcttccttccccccgagagtatttactactcgcacgatactgacctcagggaagagcgaccatcctccaccttgggctaacacaggcaggagaaacatcctggggcccacactatcgccccccgcgagaccactgtgttcccccgg

SEQ ID NO: 108239 - DNA, 588 bp, Homo sapiens
  misc_feature (2)..(2): n is a, c, g, or t
  misc_feature (8)..(8): n is a, c, g, or t
  misc_feature (26)..(26): n is a, c, g, or t
  misc_feature (33)..(34): n is a, c, g, or t
  misc_feature (44)..(44): n is a, c, g, or t
  misc_feature (49)..(49): n is a, c, g, or t
  misc_feature (66)..(66): n is a, c, g, or t
  misc_feature (70)..(70): n is a, c, g, or t
tntttacngcattagggacaagtggngtccacnnggtgagaccntctanaatatggttccccgggntgcngattcggcatcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttta

SEQ ID NO: 108240 - DNA, 325 bp, Homo sapiens
gagttaggattaagtaaaactacagtctttcttctcaaggaacttacatcaagcagaggaaatgagacttaaatataataatcaggactgggcatggtggctcatgcctataatcctagcactttgggaggctaaggtgggtgaattgcttgagctcaggagtttgagactagcctgggcaacatggtgaaactccatctctacaaaaaatacaaaaaattagccaggcgtggtggtgcaggcctgtagtcccagctacttggggagctgaggtgggaggatcatttgtgcccagaggtcaaggctacagtgagccgagatcgcg

SEQ ID NO: 108241 - DNA, 381 bp, Homo sapiens
tgggtggggcagagtgagcgaggggcaaggcggaggagatgagacagagaggaaggcaagtttcaccaggccttccaagccacagcaaggaatcagggcttcatgccaactcaactgggagcccctgacctggcttaaagcagggaagcaacacaatctggcccgagtttgttctagtagtgctatggctgcagtgtagaaagtggagcaccatgcaggtcccattcggagcactaggagcgtgtctggaaacagctgggtggcatccatccaggcgtctcctcctgagctcccctagggacctagggacccatggtagaatgtctgtctgctcatttctctggccagcctccacctccctgcctccacccacaccagaca

SEQ ID NO: 108242 - DNA, 713 bp, Homo sapiens
caactaaaactgaaaaaaaaattaataaatgatttgggatgttactttacatctttaaaatatctttacttttgccatattctgttagcaagaagcaagttataggtctcgcccacacttgggggaaagtattagacagggcttgagtaccaaggggattggggaccatgggggcaccttagagtctgtctgccacatttcctaaaactcagaagcaaaataaaacaagtgaaattcacagcataccaaattggtgtcaaaacaatatacagagatcttaaactatagtaatttgtctgtatatccctaatatatacacaaagacagaaaaaactgttttcagtaatcatgttgttaataaaaatattgactttaacctaaaactagtatatggatataataggataaagcaaataagtaattatgttagaaagcaagatgttcagcataagattagaaagatacaaatatatggccaggcgttgtggctcacatttgtagtgccagctgtttgagaggctaagacgagaggattgcttgagcccaggaatttgagcctgcagtgagctgtaattgtgccactacactctagcctgagtgacacagtgagaccttgtctctaaaacagtaataaaataaataaaagatacaaatataaaatcaaataagtaaaaatgttatattcttaaatttggattctaattagcaagatg

SEQ ID NO: 108243 - DNA, 223 bp, Homo sapiens
tccagtgaaaccacagctttcctatgctaaaaatatgtacctcaaaaaattagaatctcattcatcaggtcccagtgctcacactgaggcatgccttagcaactataagcaatgaaagggataaaaaacagattcttctccaggtgcacatcattcttggccatttgccaaggtataggtatacaagtagtttagacctttttctcttaagtttccaataaca

SEQ ID NO: 108244 - DNA, 435 bp, Homo sapiens
agatgtagtacttataaaatgaatgttacctctcttgggaaacagactttttttcttcgcaactctttggagagcatgtcccttgaggtgtgacattattttagctgtgtaacaattaactggatctgagttgttttacatcagctaaatatcagtctccttgagatttgggaaatatttaagtctcatcagcagtattttggggaagggggtgctcctgcagacagcagctgctgttttctgtttgtttgttcattgattgattgattgagacacagtctcgctcttgtgctccaacattggcagtagagtgagactttgtctctaaaaaaccacaacattttaaaatttatttaatgtccctggattcctacaggtattgaattcctatgggtatgggattttgactgtggtcttttcctagtttctataact

SEQ ID NO: 108245 - DNA, 264 bp, Homo sapiens
cttattagctatattaatataaaaactcaaggagatattccttaaatgatatcatggagattatcagtacattaatcaaagccaaacaatgctaatatgaaaggaaaggaaagccaaattattatcttacgagaagttttaatggttaaaagctggaggccgggtgtggtggctcatgcctgtaatcctagcacttcgggaggctaaggcgggcagatcactttgagctcaggagtttgagaccagcctggacaacatggtgaa

SEQ ID NO: 108246 - DNA, 178 bp, Homo sapiens
cccgacacattcctggctttcacgttccatgttaaatcaatcatgaggatttatctaacctgtatacaccctttaagtgtccactgttctccaaccccatcgtctcctctctgctccaaaacgccatcatcttttgctcaaacagctgctagctgatcttcctgcatcccactccact

SEQ ID NO: 108247 - DNA, 310 bp, Homo sapiens
  misc_feature (29)..(29): n is a, c, g, or t
  misc_feature (41)..(41): n is a, c, g, or t
  misc_feature (47)..(47): n is a, c, g, or t
  misc_feature (57)..(57): n is a, c, g, or t
  misc_feature (158)..(158): n is a, c, g, or t
  misc_feature (177)..(177): n is a, c, g, or t
tcctagaacttgatatgtactcaattttnctaaaagcaganaagcanagtaccaaanacatacacaaggaatttaatttcttgttatcaacatgcccttatcatttagtctctgggaggagcagcctgtgggtgtagaatacatgggcaggtgagganaatgcagtctttttaaagnactgtgtgaagaaaagatggggtctggagacctggttttggctgttcctgccaatccaggaaaacaggggtatggcaaggagctgcacctccccctcagtgtagaggatcaaacactgtgacagcacaaagtg

SEQ ID NO: 108248 - DNA, 514 bp, Homo sapiens
ctgttacagttttttgcagtcagaacttgaagaaagtgctatcccctgcctgtctaacctgaaaagtagccaggggcccaagggtcacaagaggctccagggacaggtgagggcctcttctctgcatcaccactcaagcagcatcaccatagcaaccccaggagtaaacaatggtgccagaaagggcttccccacaaagccgcccctcctggctctgaggcccagaagaatggccagtaaccggcaaagatcactcagagggcccagtcacccatctcatatggaagaacctttcctgcaggtagggggtggcccatctctgccgcctacctttttgtaccccactgggctacaggctgtcccttatagtgggccaggctttcttctgggcagcagactgcctggcccatacattttctgctgtcttccccttttcatcctatgacactaggaacccagagctcagaacagagaggagatgcctggctagtgccacatctcccagccccaccca

SEQ ID NO: 108249 - DNA, 559 bp, Homo sapiens
gaggggggagggatggcatcgggagatatacctaatgctagatgacgagttagtgggtgcagcgcaccagcatggcacatgtatacatatgtaacctgcacaatgtgcacatgtaccctaaaacttaaagtataattaaaaaaataaaataaaaattaaaaaaaatgacatgaaagcttaaacctgggaaagcaagtaagacaaaagccatcttttaccttgaagatcagggtaagccctgattaccctgagcctctgttgtgctgactgagatggatgcaggaggtaaagcagggcctgctcaaggcaggaagtttaatctgagatctcccacaaagtggggaccctccaagtgctacccttactgtgtaaaggtaaacactaaataagccaccaagcagaaataacagcaaggaaaattgcctttcttgaccttggccctgggtggaggaaaagctgttcctgtctcaccaacctaaaaatgtttaacaagttgtcccttacatagagagttgggcctcaaatttatgctacttgtatgttgcaaaatactgcatga

SEQ ID NO: 108250 - DNA, 591 bp, Homo sapiens
gttctccagctatcatatcagaaaacattactatttccccatttttcaccttcttgggtgtctctcagttgggtcctgaatgtcaccccctgtccagccttggtcatcccagcccaagcacaggcacaaacctctttcttgcttccccttgaaaaatgaaggtcacctatatcaacctcccgaaacaacacattcgactgtctctgcctgttgaaatcctggttaaggtccatctcagaaactgcctcttccccgattatctccactggctatgagctctctaatccctgcaccagagagtatttgatctgtttctctctctcttttttttttttttgagatggcgtttcgctctgtcacccaggctggagtgcagcggcgcgatcttggctcactgcaagctctgcctcccgggttcatgccattctcctgcctcagcgtcccaagtagctgggactacaggcgcctgccactatgcctggctaattttttgtatttttagtagagatggggtttcaccgtgttagccaggatggtctcaatctcctgaccttgtgatctgcctgcctcggcctcccaaagtgctgggat

SEQ ID NO: 108251 - DNA, 342 bp, Homo sapiens
acatgatcattatctatctccttcccctggcatataaacaccatgaacactaagaatataaccaccttgtttaccactaaatccccaaagcctggaaaaatgcttgcctcaaattagttacacactgtatgtttaatgaataaacataaagtctacctaagtccttaagtagactttcttaataatcctacaaaataaagacaaattagtgaaattataacttataattgcattgcaagattacaatcctctggttgaattttatggcttttcaaattgaggtcaggaatgttcagcatgtaatcctaaccatgcaggtaaatttgtaaagtaggctgttga

SEQ ID NO: 108252 - DNA, 483 bp, Homo sapiens
caagatcctcaaactcacccatgagtttgagtttgacagggatggcagtgggaaccttagggctgcgtgctagaagctgatgggttccagagaccgagtcacccagaaatcccatctaattctaagatttgatgagccctatatcaggaggagacaagacccgagaaactatcactgtggtcacctccagggtggctggggacggtcagagagaagggggactggttttacttttgtcttttcacccatgtgctacccatacaaaaaataatacacgtgtatatttgaactgaatatttctaagagtctagccttctaagcctccaagattattacaatcattctgagatccagactgattctcagagactgctggcaaagattcgggggttgggcatccgtgggtttggaccccggctccgtgcatttctgtgcctcagtttcctggtgtgtaacccaggacgaggatacccacttccgctg

SEQ ID NO: 108253 - DNA, 176 bp, Homo sapiens
ttttggtgtcttaacaaaaatatatgtttcttggatttctgctaaataataattttaataaaatagtataataatccctctccaaccctgaattcccctttaacagaattttcctcaatgtggatttgcttctgtatacctttttcaaatcatgaggatttcattttgagtatcct

SEQ ID NO: 108254 - DNA, 337 bp, Homo sapiens
ctgtgccatctgaatacaggaaccattaacaggaagtacctacatgtctgaaattatatcttctgaaaacaaaaacaaaaaacaaaaaccaaagcaatgttgggcaaagagctccagatggtccagacggtgaccagagcagtagggagccagtatgagttgttgacaagaagagtgctctggtcagagctaggctttaggaccatcagtcaagcagccatggaggatgcttgggaggcagagcctcccatcaggaaaccccaggagtcttgtgtagagatccaggagaggtgaccacctggcgtgaggccgtggggctgaggtggagggaggtggg

SEQ ID NO: 108255 - DNA, 141 bp, Homo sapiens
tcagccttatatctcttgacccctgagcaccatgctttgtgaacaatagatgctcaacaaatatttgctgaactgaactcactgaaatgcagcttaaatcatattccagaaagaacatgaagttctttggaagagactttc

SEQ ID NO: 108256 - DNA, 651 bp, Homo sapiens
ggagggagatctaaagaggatggggagattggccctggctatgttgtgataccattgttaaccatttttttggtttgtttttggttttttgtttgtttgttttgcttttccttttttaataggacattatgggtttaaatattctaagtaatttgatgtcttttgtaatctctttgcactgattttcagcttgtctctttgagtgatcatttaaggctctctctccctcattatttttatgatggtatacccctgccacacacacacaaaaagcaaaaaacaacaaaaaatctcctcttaagcatgctgaaaataggtaccagttggtttcctagaagggaacagcattcagagagaatttcaaaatcctgatttggtggtcttctttgcccttgtcttagagataaataaagtggactcctttttttattgatctttgcatgatcctgctcttggaatataacactatgtgccaaagtgtttgaaagaaatctaggtgcttagtgagagtgagaaataattttatttgaaggtggggtaaggagaaaagcaaatgcttaaattcacattggagatgtgtgttaccattttcttccagtaagtggcagcagggatctacacattttatcctaattgttacaatctagaaaa

SEQ ID NO: 108257 - DNA, 3113 bp, Homo sapiens
cgtttctgcttggaggtccttattgttaacaatagcttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108258 - DNA, 3727 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108259 - DNA, 3517 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108260 - DNA, 3804 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatggtgtgtcccgttgcctgttggatctgtctccatcttcactcagacagaaggctatagaaagatgcctgtgacttcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108261 - DNA, 3814 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaaggtatcaactgagagtggtgccagctgatgaacagaatgaccggatgcatctcactggtgacaattaccatgtctttctgttcttaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108262 - DNA, 4124 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaaggtatcaactgagagtggtgccagctgatgaacagaatgaccggatgcatctcactggtgacaattaccatgtctttctgttcttaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagcatgaaaatgtcatattgccttcttaatcaattattttcaagtagtgaactttgtatcctcctttaccttaaaatgaaatcaaactgaccaaatcatcatttatgtggcttctgtgtgacttggggaccatttcatagaatggcactacagtgttttccaagttcagagaacagagcgagtagatccacactgagaggaatgtgattctctggactcacgtgttgggggcaggtctgtgtagtgtttcagtcagtgattgtaacttctggtgtttgaaatgtatcaagaaataaagtgctgtgtttaaa

SEQ ID NO: 108263 - DNA, 3625 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaaggtatcaactgagagtggtgccagctgatgaacagaatgaccggatgcatctcactggtgacaattaccatgtctttctgttcttaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108264 - DNA, 2198 bp, Homo sapiens
cagtcgagctggtacctcgattagcaagccctggtctgtgatggtgtgccccaaagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108265 - DNA, 1273 bp, Homo sapiens
tcccccgggctgcaggattcggcacgagagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108266 - DNA, 2315 bp, Homo sapiens
  misc_feature (2286)..(2286): n is a, c, g, or t
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaaggtatcaactgagagtggtgccagctgatgaacagaatgaccggatgcatctcactggtgacaattaccatgtctttctgttcttaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagganccggggataatcactagtgaattcgcgcc

SEQ ID NO: 108267 - DNA, 698 bp, Homo sapiens
gaaatatttaaaataaacagctgaacttctgcatagtcagggctctgggcagtgcctagcatccatcacccccacctcccatacccagccttgcttcctggaaatttcatggcagcactaagacattgcatgtactcttctttttgcttctttatgtaataatgttactataggcagatgtatcttatctagtgctatgaagagccctaggagtaactggcagtaaatggataatcatcagggagtgtgattacaataaatagagttttcagtacaaacaatattgtttcatacaattgacttttgaaaactgtttgcataggatctgtaatatttctttgtccaagagggtaggaatacggcacgttactcagaagcattcccagtgaaatttatctcctgctatttcagctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgc

SEQ ID NO: 108268 - DNA, 3915 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggggacattgggaatgatcaggtggttccagaagtgtttcaatgctcagcttcgtatctccctgactgaaatttatggtggtgatgtagcaaccaaaaaatggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaaggtatcaactgagagtggtgccagctgatgaacagaatgaccggatgcatctcactggtgacaattaccatgtctttctgttcttaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatatttttcataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaacta

SEQ ID NO: 108269 - DNA, 2351 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctggtaagcgcggggtgccctgtgcctgtggaaggaaagatgggttatttttcttatttataataaaatgacatagtgacacccaactagcccatacattttataaagttctttcacatgtttctatctcat

SEQ ID NO: 108270 - DNA, 2297 bp, Homo sapiens
ggccgagactggtgctggggggcgcccgcgcgcgtggggagctgcgggaggcgcggcgcggggggggtcgggtgcgcggcgggccgcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcggagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctggtaagcgcggggtgccctgtgcctgtggaaggaaagatgggttatttttcttatttataataaaatgacatagtg

SEQ ID NO: 108271 - DNA, 424 bp, Homo sapiens
attttttccaaaaacctaagaaaacccttttcctatagaaacacaggttcccatatgattataaaacattcaaatactagctcaaatattgaatgggatacaggttgaatatccttagtccaaaaatctgaaatcatttcaaaatccaaaactacttgagcactggcatgatgttcagaggaaatgctttgagaagtgctcatttcagacttcaaatgttaaggatgctaagtttaatgcaaatatccccaaatcagaaacattgctgttccaagaagtataagctgaattataaataggatgatcatataatttatcattgaaaacaggatacttttgagaatgaaagcaggcactggatgtctccattaaaaatgcactaatttataatgtaaaacattttataaatggttgtaataaaagt

SEQ ID NO: 108272 - DNA, 485 bp, Homo sapiens
gctgggatttggaagaaggaattaagaacaatggtggcagaaaacactggaatgccacgcccttcaagtaacgagggctccacacatatataccaatgtactggctaatgaagccagacaacttcattgcagtgggcagaaggaatcttccttttctctttaagatatagcttgttctaaacatctttccctgactcgaaagagcagtcaacaagacactaactttcttttattattattattatttttgagacagagttttgctcttgttgcccaggctggaagtatctgggtgcagaagagtacccatcccgatgtggcaggacacgggaaaggaaaagagcccaacaaggacattttggaaataaagagctagcatttaggctggaaatctgccttaaagccccagaagaagagaacttggaacccatcctgtaaattaccacggccttctttaacatccacccacggcaaaatatttaagt

SEQ ID NO: 108273 - DNA, 402 bp, Homo sapiens
gagattaaaattcttgggatggaggaacctagcaatgttacggtgaaacacaatggtgtcccaagtcagacttctcctacagtcacttatgattctaacctgaaggtcgccattatcacagacatcaatcttttcctgggagaagcatacacagtggagtggagcataaagataagggatgaagaaaaaatagactgttaccctgatgagaatggtgattctgcagaaaactgcactgcccgtggctgtatctgggaggcatccaattcttctggagtccctttttgctattttgtcaacgacctatactctgtcagtgatgttcagtataactcccatggggccacagctgacatctccttaaagtcttctgttcatgccaatgccttcccttccacaccc

SEQ ID NO: 108274 - DNA, 154 bp, Homo sapiens
  misc_feature (133)..(133): n is a, c, g, or t
  misc_feature (153)..(153): n is a, c, g, or t
ctaaattgcagttaatatgacttattcaagacttatcaacttctttttgtcatgtaacttccatatgaaaaaagtacacaaatcctgagtgatttaattctcaacagatcacaccactgcactccagcctggntgacagagcgaggctccgtnt

SEQ ID NO: 108275 - DNA, 794 bp, Homo sapiens
ctgtctcaaaaaaaaacaaaaaacaaaaaacaaacaaacaaacaaaaaacaaaaaaaaaaccacacatacacacagaaaacaaaaagcgaaaaaaaccacaccaccccaaaacaaacaaaaaagatgtaaaagtgaccttgcacataacaagcttccagccaagaagattgaaaagcagttaaatagaggaataggtagactatcatttgcttagtattttataattttgagtctttgttctgaagaaaatgtgacctttgttaaattttagataaatatgagaatgaccttgattctttggttttatcttcagtaatgttaaaaatgcaagtatgttgaagtcatttgttgtttttctcagataagcctcgtgtatttgaaaataattggaatgatttctgctcggtagtagtatgattttcctagccttatatcttttatgcagtgctctcaaggaatatgggtggtacaaggttataatatactggcaaccgtgtttcttaaggatttgacgtgaaagaaggtataactttctataggcgattacagataagaacatggtactgtgagagtacataggaaaggtgcttacctgcagccctgaggatcaggaaggtgctttatgagaagtgacaactaaaccaggacctgagatatgggtggcagttaaccaaataagttagtgagagaagggatgtgaaagtaaaggaataattactgcagaagcttggagtcagggctgcagagagtttagagatcagaaagatgttcttcgtggcaagaatatataccg

SEQ ID NO: 108276 - DNA, 246 bp, Homo sapiens
gagaatgtgtgcaccccacactcttccttgctcttcccacatctggccagactcgggccattaactgtctttattggctcagctctgctgtggttctctccaccactgtccatctgttcagtggtaacattcacatttcagccatgatttcaggaaccacaggactcattggaggttcttaggggccggtgttgggggaataggaatgcccagtgtggaacggcgcacccactccagctatacttg

SEQ ID NO: 108277 - DNA, 429 bp, Homo sapiens
cctggagcactctgcattccagttcactctcaacttcattgctcactctgattctttgtgtagttttggaggttttctcccttcacttttttcttctttactctttttacttttcattcacttttgtttggggaggtcaggatcagcctggaagtcagggtcaactgggctagggaacacccttagggaaaacaaacttatttttcctaaggaaattagaaggaccccagctgatccctgcaaggagtgattggcatttccctttcctttctgccctctctccatattgccatttgtggctgattatctcttttccctgatatatatttcctccccgtttttcatcttcctctctttttgggggtccttccctgccttggccttgtaggcttggggctcagtggttccttgcagtctgctgatgacatc

SEQ ID NO: 108278 - DNA, 194 bp, Homo sapiens
cacacccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaaaa

SEQ ID NO: 108279 - DNA, 568 bp, Homo sapiens
tgttattgtatactgatacttcatttcttataatatagtttgccttgaaagataccttcttggaaatacacatacccatgatatttttcatgtgctattttattactatttgttttccatatgtcctttctgcctttttccccactgctatgtttgagtgtttgtgtcccaccaaacataaatgttgagaacttactcaccagtgtgataggattatgacatggggcctttgggggtgattggatcatgagggcagagtcctcatgaatgggattagcaccctcataaaagagggtccagagagctgccttgtccctccaccatctcagaacacagatagaaggcaacatatatgaatcagaaataagtgggccctcaccagaaatggagtcggccagcaccctgatcatggaagtcccggcttccagaactgtgaaaaataaatttcagttgtttataatccattcagtttacagtattttgttacagcagccaaaatagaccaagacaacctcttttatcccttttctgctttgtgttagtcaagcaatttttagtattctatttc

SEQ ID NO: 108280 - DNA, 682 bp, Homo sapiens
ttgaattcttggtgttaattatttaacttgatgttaagtattaattcaagaaaaagtaccacagttcatttgttttatggataacaatgacagcttttttttttgttttggaaatggatccattctatctaaatatataatagttaaaattttgctgtaacttcagctttctggttagatagggtctcactagaatgctctctttgggaatcaagcaatgggaccagcttataaaagtcttttgatccttaaatgaaatagatctccttgaatgaaatcccaagatgaatttatgtatgtggaatccctggaaaacagtaaatgtgtcagaagaagttcatgatcttactgtgatagattttgtgatttctttaagggaagagcatgcacatataactactttgatgtggttcaattcagagcaaattcaggcactgactgtcctttgggtatctcagtgtttggaaggggcttggataattctgcagcctttccaggcttaaggacccagggcagaaacaggggcttataccaaaaccgtgccattttggttgtaacatattgaacctcaaagaagacttcaaatggttcttaacttgaggctttgaggatcaacttggaacccaattttcgtgggagtttgaggtagtttttccttgggagggctttataggacccctat

SEQ ID NO: 108281 - DNA, 741 bp, Homo sapiens
  misc_feature (34)..(34): n is a, c, g, or t
  misc_feature (92)..(92): n is a, c, g, or t
  misc_feature (102)..(102): n is a, c, g, or t
  misc_feature (131)..(131): n is a, c, g, or t
  misc_feature (291)..(291): n is a, c, g, or t
gggctgtttcatgtcaagagcgaaaaaggctatntcagactacacttgaatggggaaaatctgaaattttcatgtggttattaggaaaagtngtatttgatnatataaaacatgtatcttctctaaaatcnttgtttggagacagggtctcactctgggtacccagacagagtgcagtggttcaatcatggctcattgcagcctcgacctcccaggctcaggtgatcttctgacctcagcctcccgagtagctgggattacaggcatgcaccacatccaactaattttttntgtatttttagtagagacagggtttcaccatgttggccaggctgttctcgaactcctgacctcaggcaatccacccgtcttggcctcccatagtgctgggattacagacatgagccattgcgcctggccgatgacattttattaattgaaattctgttctacatttaaactaatttttctctttccttgattactgaagaaaagagatggggaatgattttgacatttttggcctgcttagttccaagagaaatttgatttatggctggcttttggaaggcaggagccagtaattctaatcttacctgatttgatcgaatgaccttgagcaagtgacttgatttcaatgatctgatactttcaaaaaatcccaaagccctttgaaaaactagaactgcatcttagtcaatcttttagagaatttttaagaaatcatacctcaataaagct

SEQ ID NO: 108282 - DNA, 434 bp, Homo sapiens
tggcctcagagagtgaaaggacggcagctagtctctgaaggtcagggcagtgcagatattggcccaaggtcacacagcaagaaactggagaagccaagatctgaacccagatccagctgaccccaaagcacctgccccatacaagccaggtgtacccagagaaggctcaggctgagccgggcattcacactcaacccaggcagcaggccccgccccactccacccacttcttcagccaggccagcctagaggctgcaaaggaggttccaagagctcagaggccagggaagaggaaggcccagtccttttcttgtcgcagcctcaatctctcgtgcagtgacggggaaaaggaagacctcagactcctcccagccccactcaggaatgtgcaaaaactgcccaacaaaaagtgccacttttcaaatagaaggata

SEQ ID NO: 108283 - DNA, 620 bp, Homo sapiens
tagtctagccacgaggaattgcttcctatgggagatgttgttttagctgagacctgagcaatgtgtgagagttagctacaggaaaagtgaagagtgttccagacagggggaacagcttgtacagaggccaggaggttgatgagagcctgtgtataactgcaggactggataaagcccaggccagttggaatgtggggaggggacagcatgcatgtatatttcaaagttcttgggtattgattacaaatgatcggcctcatgactctagatgaagactcatgtgttatgagctggttatactctccctgatggcagagttctccccaggggtcatctgctaacccacctgtcctggaagagaagtgagaacagaggttgctccatgcgaagtcaatggttcttcattttggaagaggtcatggaaatttctgagaagctctggacccttttcccaagaaaaagcatgtggcacatttgaaacgttgcatatcatttcaagaggttcacaggcacctcttgaagcttgtccatgaattggaggtataaggaccactggttggaaaccttggcttctttccctttcaccagaggagcaccatttccacctggaaatagtgctg

SEQ ID NO: 108284 - DNA, 434 bp, Homo sapiens
tgtctttattctggagagttggggagcaaagttaagaatacatagggcaatgtttttaactaagggtatatattacaaccctctttggaacttgttaaaaatgcagatgcttggaacaaacttatgaaaatagggattcagtgagtgaatctgaaaattcatattttataattctggaggtgatcctgatgacctgctgattgaagattaatatagggatggctggagacagtgctgcgtgcttatagttccagctacttgggaggctgaggcaggaggatcgcttgaactcaggaactgaagaccagcctgggtgatacaatgagaccccctctcacacacaacacacacaaaaaaatactaaatagaaaatgaaaatttttctacttgaattatttaattcaacacttcatgtcctcattttgcttttaact

SEQ ID NO: 108285 - DNA, 639 bp, Homo sapiens
ttcttggtcagttctgatgccagcgggatagtcctcaggagtcactgaagacattcagattttccatcttcattccgtctgctcagccttgccctctcttctcgctcagatattcccgcacactctgacccagaccagcgactgaaggtggaaatgatgctggctaatcatttggatcctttgggagaatcgatgatattctttcagctaatagcttttacttataaatggaaactttaagaaatacaaggtcaataatgataacacatgcattctagcctcaaaaattagataattagccatcttagccatgtctgatttccttctccctccttttaaggtttcataaaattgcccaggtctaggcttaagcagatcctaattgcaggactatagatttgcccttgcggtttgctgcctggcacccttgtctgagtgtgccatagctgctctggtgggtgacatgcagttgcttagagcaagcccactaatgatgtgattatagaaacttcttggcttccttttgtccctcaagtttccatggccctgacatgttgagcacagggctagatggtgttagcatttttgtctgatgggctcttgcttcattacccagcatctgggcccagtgttggtgcc

SEQ ID NO: 108286 - DNA, 138 bp, Homo sapiens
gagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttg

SEQ ID NO: 108287 - DNA, 341 bp, Homo sapiens
catcttcttctgaacgcgctgccgggtaccacggctttctttgtctttatcgtgagatgaaggtgatgcttctgtttcttctaccataactgaagaaatttcgctgcaagtctcttgactggctgtttctccgacttcgcctttttgtcaaacgtgagtctttttacctcatgcccctcagcttccacagcatcttcatctggatgtttatttctcaaagggctcactgaggaaacttctgattcagatgtcgaagagtcactgtgagttttctcttcattttgctgcaaatttgcctctttgctgtctgtgctctcaggccacccatttgttgtcatggg

SEQ ID NO: 108288 - DNA, 2330 bp, Homo sapiens
  misc_feature (1782)..(1782): n is a, c, g, or t
tgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108289 - DNA, 2303 bp, Homo sapiens
  misc_feature (1755)..(1755): n is a, c, g, or t
tgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108290 - DNA, 2594 bp, Homo sapiens
  misc_feature (2046)..(2046): n is a, c, g, or t
tgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtaatgatgggggtgcggggtggaggaggaagagaatcgcaggaggttttagcaagagggcgagcctagggtccgagaggcgtgtggtagcgggagaggaagggcgggagcggagctggggcgtttgggggtcacccgcaggaaggcggcgaggaaggttagggagactcgggcagtgtttgaaggggcgaagcctccgggagcctgcgggtttctcggaggcgtgggacgtggcacaggcactaatcctgttgttcaaaacaggtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108291 - DNA, 2137 bp, Homo sapiens
  misc_feature (1589)..(1589): n is a, c, g, or t
tgcggagggttttgcccttcgtaaagatggccgcggaggcttttggagccaactgggagcgcagtacgcgttttctggagcatgggcagaggagacaggaacaagcgtagcatccgtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108292 - DNA, 973 bp, Homo sapiens
tgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggggaatagcttcatgccagcaaatggcctcactgtggccatt

SEQ ID NO: 108293 - DNA, 1364 bp, Homo sapiens
  misc_feature (816)..(816): n is a, c, g, or t
cggacgcgtgggtccggacgcgtgggtcgacccacgcgtccggtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108294 - DNA, 2190 bp, Homo sapiens
  misc_feature (1642)..(1642): n is a, c, g, or t
atccttaattaaattaatccctcccccccggcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108295 - DNA, 2285 bp, Homo sapiens
  misc_feature (1737)..(1737): n is a, c, g, or t
tgcggagggttttgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtggattcgaaagctatggcagctcctcatacgggggagccggcggctacacgcagtccccggggggctttggatcgcccgcaccttctcaagccgaaaagaaatcaagagcccgagcccagcacattgtgccctgtactatatctcagctgctttctgccactttggttgatgaagtgttcagaattgggaatgttgagatttcacaggtcactattgtggggatcatcagacatgcagagaaggctccaaccaacattgtttacaaaatagatgacatgacagctgcacccatggacgttcgccagtgggttgacacagatgacaccagcagtgaaaacactgtggttcctccagaaacatatgtgaaagtggcaggccacctgagatcttttcagaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccagtttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108296 - DNA, 1651 bp, Homo sapiens
  misc_feature (1103)..(1103): n is a, c, g, or t
taaggatacgaaggctcctggttaacgaacaaaaagagcctggtagcctttaagatcatgcccctggaggatatgaatgagttcaccacacatattctggaagtgatcaatgcacacatggtactaagcaaagccaacagccagccctcagcagggagagcacctatcagcaatccaggaatgagtgaagcagggaactttggtgggaatagcttcatgccagcaaatggcctcactgtggcccaaaaccaggtgttgaatttgattaaggcttgtccaagacctgaagggttgaactttcaggatctcaagaaccagctgaaacacatgtctgtatcctcaatcaagcaagctgtggattttctgagcaatgaggggcacatctattctactgtggatgatgaccattttaaatccacagatgcagaataactggatctaactgggtacctgagatattttacagctggacctagtttcacaatctgttgtctccagctctgcatatgtctggccagggggcttctaggaagtaggtttcatctatcaaatgtctcctctgacttccttttgaaacttactgctcttctgttttattttgttttgtttgaagctcagagggagatgggcaattgacagggatgcaatccagggtgggatttcttgaggaagttacaaataagcttgttacaacatcaagatagatggaattggaaggatgctaccaggagagtacttacatagtgctcaggagtttctcttcttaaaatgtttactgctgaaagatgagcaggaccagggcgttataggcagagccctagccgagaaacctgctggcctctgcctgttttcatttcccactttggttgtgtggcattactttcagaattgcactttcctgcttgtcatgactttttgacacacttgccatgacgtgtgtttctgtgaacatgaagttctgcggtagtgcctccaggggcagaggaaaagaagaagtgttactgcattttgtacaaaataaatacagtcatatgtttaataaaacagttctattgtagtaacttgtaaaaaaaaaaaaaaaaaaaaaaaaaaaaaaaaagaanaaaaaaaaaacaaaagaaagaggggggcggcgcgcctaaaaagtatcttccccgagggggcgccagcaagttgcacgcggttaccccaggtatttatgggaaccaaggggggccccataatagaggacggcgggtattaagtagccgcagagggaagcgggggccgcgcggttaataacacagagctggcgagagacagcgggggaacaaccgcgcggcaacacggggggaccccttgtgggggagagaggcaacccctctacatctcgcgggggggcggcggacaccacatcgtggggggccacaagactacctctctcgcgagaggaatatttcttaagacgcgcttctaggaggggggggacaatatttatataacattttgacgggggggtgttgatacaagggggggtggtatacacaccagagcggcgcggaaaatatatgtgagtggaggcgagtggattgaaaaaaggtttgcgggccaacacgggggatagttagtgatattgtggaggcgaaacaatttttttataccagggggggct

SEQ ID NO: 108297 - DNA, 395 bp, Homo sapiens
cctctattgttcaataggttttagtgaataaattgtcaattattttttagtgacagtcaaaataaatgaagcaaggtgactggcaccaataacccaaactgtgagaaatttacctagaaaaaaagccaactaccaatgagtcaaataataatatgaccaggaacaataaaatgtggtaggaagaaatgccagaaatggtagcaaaaatgtaacagttcaatttatcatataatttgtcaaaaatatcctcccaagtaaaaccccaggagctctcaaggatttgcaagaagttttgaaaccacaaactttatcacctggcataatagctttataagtcataattagatatgagaggcatgggctggatgtggcggctcacgcctgtaatcctagca

SEQ ID NO: 108298 - DNA, 316 bp, Homo sapiens
actcgccgtcctaggcaagatcttactttgatggttgagaagattttacaatctattgtctgaatagcctctgaatattaagttggactccacaagttctgtagttactcagagccttgactgtttttcataaactctatatccagtctgtggacaaatcccacgtcaaagtgtatcttgaaactgaccccttcttatcttccctactgctgttaccctggtctaagctaccattatatctacttgtctccttgcttccacccttaccatttttgtaatgtttccacatagcagatagagtgatcctttgtaaaac

SEQ ID NO: 108299 - DNA, 445 bp, Homo sapiens
gtaaggaaatgcaacatgctttcgctatgctttcacagtaggatgaggctgtccttgaggtttgaggtttatttgcctaacacctggcatgcaggaacttcagtaaatatttgttggagaaatgaatgatccattcacagactcattaggccctgattgtgtctgtgggttacaatagaacactcttcttatcagtccttatctgacttgatttgctctgtgacacttaacttcctctcttttctctacccctgacccatgacactccttaattttcttctttcctcttgaatgtgtcttcttaatcttctttgcttctcttccaccttctctgtaagtgatgatgctccccgcccttcccattaggttctgtattgaccttcgatattccccttggatgatctcattcgtgtccatgacttcaaccaccaccacccagacatgg

SEQ ID NO: 108300 - DNA, 277 bp, Homo sapiens
acttacagccaactgatctttgataaagcaaacaaaaacgcagagtggggaaaggacaccctattcgacaaatgatgggataattggcaagccacatgtagagaatgatactggattttcatctctcagcttatacaaaaattgactcaagatggatcagacttaaatctaaggcatgaaatcataaaaattctggaagataacgtcagaaaaacccttctagatactggcttaggcaaagacttaatgacccaagaacccaaaagcaaatgcaaca

SEQ ID NO: 108301 - DNA, 269 bp, Homo sapiens
aggctaaaatgttccctcatttggtgacaagttcctatgcaagttttgaattatttggaataattggatttctttggcttgtgagccaaggggaatcactatcactttcttctatggtatcagaaaactccctctttcttctaagttcccctgctgcagtcttctcccccaccttcatgtgagagctacacaaggggaatttgttcacttaagtttgcagccattttgcacaccccaaagagttgaccttgatgtgaactaattgggat

SEQ ID NO: 108302 - DNA, 198 bp, Homo sapiens
ccaacaagtatttagtaagtgctgccttggtgccaggaaaggtactagatgctgaagaggaataagccctcatgccagcccttgaggagtgtgcagtccagtgggggaaagctggtatattaatgtctgataatcatgtatttatcatgatacatgataaatggctgggcgcggtggctcacgcctgtaatcccaaca

SEQ ID NO: 108303 - DNA, 653 bp, Homo sapiens
tcgactccacagcaccggcttccaggtgtgctcagaaccatagggaattttctcttctaacaagcaccagacctgcttgctgccaagcgtttgaacgtgctgttcctttgcccagagtagccgctgcttcctgcagccttctcctcccctagctaatgcccacccacctattgttgtcacttgggaagaaaacagacaccttcaaggagagggctcccctggtagcccccaccccaagacagagctggatgcccctcgcttccgtagggaaagcacttctcctgcaggatggcattgctctctccccttccatggcacgtagtatgtgctcagtaaatatgtgttggatgagaaactgaaggtgtccccaggcctacaccactgccatgcccgaacactatccatgctatggtgggcaccatctctctgatgacagttctgtgtccacaacccagacccctccacacaaacccagatggggctgtgccgctgttttccagatgtattcattcaacaaatatttgtagggtacctactgtgtgtcagaagatgttcaagatcagcatcatccgatggaaatagcatatgagccatgtatgtagtttcaagtttttcattagccacattaaaaaagtaaaaggaaacaaatgaaa

SEQ ID NO: 108304 - DNA, 327 bp, Homo sapiens
cctttttatctcctttggttctggatgctccttattgactcttctatctcttcctgaaatttgctgagttccctagggctctggcccaggctcattttcactctacatactttctgccaacttcatcccattcttcaattaccacatctatgtgccaactggacctttctctcaagttctagtgtgtattaagattctccggataaacagaactaaaggaatataatagatatgtaagaggatatttattatgggaattggctcacacaattaagttggttctctgggtttttggtttgtttagtcttttgttcttttaaactaaaa

SEQ ID NO: 108305 - DNA, 545 bp, Homo sapiens
  misc_feature (432)..(432): n is a, c, g, or t
ctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccgggganggagtaaaggcattctcctttccagaaactgtcttcacaaccgtcactgcctatcagaatcagcagattactcgcctgaagatagataggaatccatttgctaaaggcttccg

SEQ ID NO: 108306 - DNA, 484 bp, Homo sapiens
tatatccaactgacaggaaaggagttttgtttgttattttctatgtagttatataaatggccattaattaatgataaataataatcacacatcatgatgaaatgttcagttaggctgacactacagttttttggcctaggattcttctttagaccccaaagaggaatatcattgtttattgctgaaaccagaagaaataaaatcattctgcagtatatctgtcaggattttttatgctgccagaaagttatataaccgtaagtaaagtaatttcagcagcctttcataaatgcagctggaagagtgataactttaattctgctagtcaattcttgagttggtccagccagttccataatctcttgataaaatgataacaacctaacatttactagatgtcttctgtgtgccagacgtctcctcctaaactcttttcacaaataggctaatttaaacttcacaataaccttatgaaataggaact

SEQ ID NO: 108307 - DNA, 427 bp, Homo sapiens
atgtgccctcccgcccctctcaggccggacagccttgcttctggaacacacgagcacagcttcaccaggcactttctgagcaccctgcaggcgcctcccaggagtggtcagtggtcaatcagctaatgaagctgcataggacatgacccttgtttaccgcagaatgcccagagctggcaggatgttttatatgcaggaagtacccaaaatgtatttattgaggaagtgatgatggataagaggaagacggagagcgagggagagaggggctaggggcccctgcggtgtaaagggggtgtggctgggagtgtgcaggggaacagggatcatttcaaggttcctatctgggagaaaataaaaaggtttacagttagttgagataagcgtgggaatatgcgaacatttttaaagaataaaaagtttagct

SEQ ID NO: 108308 - DNA, 495 bp, Homo sapiens
tggaagaagatactggccatatacagatgacctacaaaggaacagtaaccagaatatgcacagaactcctataattaatacgaaataatttaaagaaaacggggcaaaaagacacagacatttcacagaaggttacccacaaacaataaacatagaaaattaatttcctctatattaaaggaaaagaagttaaatgaaattaattttcattaaggaattaaaggaaataaatcaaatttctttttttttttaaaaaaaaaagagttttgctcttgttgccctgcctcgagtgcagtggcgcaatctcagctcactgcaacctcccgctcacgggttcaagcgattctcctgcctcagcctcctgagtagctgggattacaggtacccgccatcacaaccggctaattttttgtatttttagtagagatggagtttcaccatgttggccaggctggtctcgaactcctgacctcaggtgatccacccgcctcggcc

SEQ ID NO: 108309 - DNA, 811 bp, Homo sapiens
tgtctctaactccacaaatttcaacatgcatacaaatcaagaaggggtgggggtgttacatgcaaattctgcttcagtgggtgttggagcctgagattctggctttctaacaagctcccaggtaagtgctgatgctgctgctttgagggccacacaccttgaggagtaggaagagtactcatactggaagagtattcagcacggactggaatcctgcatacatatctgagctctgtgttctggtatgtatatagactttttaaaaaaattagtagagatggggtctcaccattttggccaggctggtctcaaactccagggctcaagagatcctcctgccttggcctcccaaagtgctgagattacaggcatgagccactatacctggcttatatagactgcttctaaggtccattctaactgtacaattccatgattcagtcactgtttggctattaactaatttttttaggcttctgattctcattgtttataagctgctatattagagaatgttctgtactggaaggccagataaaaagtcttacttatggccagtaagttttatttttcaatcttctacaagtctgcctcaacccatgggaaatcttggctaatagtaacatgatactgggcttggaccataaactaaacttgagtcagcaatgtagggctttggttagataagcaagaatgaacttgggaatataaccaaaagaaagggacagctaatcctaccagaacaggcagtatttatatgaatacttttttcaaatatccacaactgggaaaagctgctgaacacataaag

SEQ ID NO: 108310 - DNA, 739 bp, Homo sapiens
acagtagcagtactttggttatgtttatctgaagatcttttatgatttacttgcactgaccataacctgctgtgtgacagatggggggacatcacctaacagtgaagaagtatgaactgggtagtcagtcataaatacctccttccagttctaggaagcccagttatttgcatataatttgctgtctctgctgtgtgacatactgcagaattattctctttttgatgaaaaatatgtatttggaaatatgagagccatttagccagtgatgcatatttttcttattctctataaggatcggattggtaaatatggcctcattaacagtttgttttattaactgttcaaacctgcccagacttaactacatgtaactggagcagaggaaaggacagagaaggtccaaatcaaagtgcctgattgtccttctgtccttgaaaattcagctatgggcctggcacagtggttcacgcctgtaatctcagcactctggggggctgagttgggtggaccacttgaactcaggagttcaagatcagcctgggcaacatggcaaaactttttctctacaaaaaaaatacaaaaattggctggacacggtggctcacacctgtaatcccagctactcgagaggctgaggcaggagaattgcttgaacccgggaggcagaggtgagccgagatcgcgttattgcattccagcctgggcaacaagagggaaattccgtctcaaaaaaaaa

SEQ ID NO: 108311 - DNA, 429 bp, Homo sapiens
ccaggctccagctatcctcccacctcaacctccagagtagttgagaccacaggcgtgcactaccacgcccggctacctttttgtattttcagtagagacgaggtttcgccgtgttgcccaggctggttcaagcggagctcaagcaatcagcctgcctcggcctcccaaagtgttgggattacaggcatgagccgctgcgcccaaccttcttctgctgtcgagatactgctcatcacctgcctgctccagaattcatgtggcttctcattgctcaatggattaagttcatgtttatcctggctttcaagtctttccgaagtgctgaatgaaagaacttgtaaggcatttcgggaatgccaaggagggaatggacgagtgtttcctgggctggaaaacctttacagagaaatggatcttggcaaagaattc

SEQ ID NO: 108312 - DNA, 131 bp, Homo sapiens
gtgtctgcctggaatgctcagggaatctgcctgaggaacacctttttgtctttaaagattatttttgtgtcatctcaaggacgacacattccctacaccagggtttctcagcctgggcattgttgacctct

SEQ ID NO: 108313 - DNA, 422 bp, Homo sapiens
ataaactgctctccaatccagtactgataaacgacgtggggaaagactatggaggttactttcaaaacaaacatttaccatgttccaggaaatacatgtgtttgtataaaaagcaggtagcaattacataaacttttttcttctttatctatttgccaagcaattggctgttaaggtctttttggttgcctttgggcactttgtgtgcactcttttctgcttttaaaaacataatgcatggtaacccatttgccactgactggcattgtgaagagttggaatggggcagtgtaataacatgaaaggctgatgacaaatttagtatttgtaatttggaatctcttctcagtacattagaagtcttccctatttaaaggaaccctgaaaccatcattttatcaagtgaagagtttgtaacacat

SEQ ID NO: 108314 - DNA, 586 bp, Homo sapiens
gcttttcttcctcccctgttttggaaaagcaaacccagggggcttgggcttaacaaggagaggcttcctggaagccagtgtccttccagttctctggccttgcaattaggtcagagcctcgtcccccaccagccactgtgcagaggggagactgagtccccagatggaaataacttgcctggggaaggacaagagggactggagatagatggagttggagactcatcccagctctgctgctcactagccatgcagccttggacaagacacttcactcccaagtcttttctgtagggggtggaggggctgtgctctgtacctgcagagtgctctgcagaggggcactgttgccctagtcagggctgctgggctgaagctgagtctctgactcccattccagtactcctgcctgcagccaggcctctgagtacagacagggcactttcacaggtgtgttcctcccggttagattccccatcaggaatggaacaggttggctatgtgctccccaaatgtagttcctggtcttgaggcctcagcctgcagctttgctggatgccctccttccctgctccacagcccaccc

SEQ ID NO: 108315 - DNA, 504 bp, Homo sapiens
aaattctgttctccttaagtggcatagcccatggtaagtcctccctgcctgcgaacctattcataggttcgcaggtgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacccgccggacccgagctcaccctgaacccattactccgcaccgttacaccggc

SEQ ID NO: 108316 - DNA, 2470 bp, Homo sapiens
acgtggcaagtttcagatcagtcgaagctggagactggaggtcgttggagtgctgttggaggaagtactgttggaggttggagcaaggagagtagttgttggaaggaacttcttagaagagccagtctcgaagatatggtgtagacaaagcctgaagctgcactcttactacatttgcaagttgatgtccagtgttcggtattctatttgtggctacacaaattgagaaatgtgaaaaatagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagcaaaaaaaaaa

SEQ ID NO: 108317 - DNA, 2911 bp, Homo sapiens
gcccgcggccgcggactttgcggcgggagcgcggcgcggtgaagcaccggcgcggagggcgcccggcgtaggcggcggcgggtgtgggccgagccggtatttatagctccgtgacagcagcagcggcagcgacgccgccggcccgtctcgccgcgcttcccagcgaggccgccggcgcgccgagggctgtgctcgaccgcgaatcccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatgggagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagcaaaaaaaaaa

SEQ ID NO: 108318 - DNA, 2811 bp, Homo sapiens
gcccgcggccgcggactttgcggcgggagcgcggcgcggtgaagcaccggcgcggagggcgcccggcgtaggcggcggcgggtgtgggccgagccggtatttatagctccgtgacagcagcagcggcagcgacgccgccggcccgtctcgccgcgcttcccagcgaggccgccggcgcgccgagggctgtgctcgaccgcgaatcccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatggggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagcaaaaaaaaaa

SEQ ID NO: 108319 - DNA, 2563 bp, Homo sapiens
acgtggcaagtttcagatcagtcgaagctggagactggaggtcgttggagtgctgttggaggaagtactgttggaggttggagcaaggagagtagttgttggaaggaacttcttagaagagccagtctcgaagatatggtgtagacaaagcctgaagctgcactcttactacatttgcaagttgatgtccagtgttcggtattctatttgtggctacacaaattgagaaatgtgaaaaatatacgagttttcgccatgttactcaggttgctcttgaactcctgggctcaagcgattcacctgccttgtcctcctaaagccctgggattacagagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagcaaaaaaaaaa

SEQ ID NO: 108320 - DNA, 295 bp, Homo sapiens
aagaatttttttaaaaaattagtagactgtgtgtgtgtgtgtgtgtgtgtgtgtgtgtgtgtgtgtagttttaggtttagagaaaaattgaatggaaaatatggagtattcccatatacccttcaccctgccatcatcaccccctgacccctgcactccccagttttcccttttatttacatcttgcattattagtggtacttttgttacagttgatgagccaatattaaaacactattgttggctaaagtgcatagtttacattaaggttcactcttagtgttgtatattctat

SEQ ID NO: 108321 - DNA, 437 bp, Homo sapiens
ttttttttgatggaggagtctcgctctgtcacccaggttggagtgcagtggcacaatctcggctcactgcaacctcgcctccctggttcaagagattttcctgcctcagccttctgagtagctgggactacaggcgcccaccaccatgcctggctaattttttttattttttgtagagatggggttttgccacattggccaggttggtcttaaactcctgacgtcaagtgatcgcctgcttcggcctcccaaactgctggggttacaggcgtcggccatccaccatgcccttccagagtatgtttttccttagttacatggacaatggaaaagggcaccaggctgaggtctatcttaaagttagtatgttcaagttagtatgtaaaagtggtacagccctggagaacttcagccgtaggagcctgggtctgtaaccc

SEQ ID NO: 108322 - DNA, 174 bp, Homo sapiens
tgctgggattacaggtatgagccactgtgcccggccttaaggcacataatttatttttaagggtttctttaaagagttcacatgttgtcactactgtgaataaaatagtttgtctattatttgtctattatgttttcttccttccttcctttcttttttttttttttttttttt

SEQ ID NO: 108323 - DNA, 344 bp, Homo sapiens
tgcacaaaaacaagaagaagtgagtggaaaggcacgctgggcagagggaacagcgagaacagatgctcagaggcaggaggtggggtgaggttttcagtggagggagcacagagcccagtgaggtttgtgagcccaggttggaaaggtcgtttgggcacagatctctaggaggtctttccggcctgcctgagaggaagggccagcttccgggaaatgcaactcgcacagtcacacaaggggagaacttaacagggcttcgtggttagtttcatgctctgcagtcactggcttgaaattcctttcttgttttttaaaatttttttcaattttatgtatttatttat

SEQ ID NO: 108324 - DNA, 710 bp, Homo sapiens
gccagcgacccagtgaccccattccccggggtgatcagccggtgaccccaatccctggggtgatcagccagtgaccccattctctggggtgatcagccagcgacctggtgaccccattccctggggtgatcagttggtgaccccattccctggggtgatcagccagcgacccggtgaccccattccctggggtgatcagccggtgaccccaatccctggggtgatcagccagtgaccccattctctggggtgatcagccagcgacccggtgaccccattccctggggtgatcagccagtgacccggtgacaggttggtgacactggatcacttccatcacggaaggggcagcattttgtcctcactggaatagacactctagatcgggatttgccttccctgtacgtcacgctcctgccaaaactagcgtccgtggactcacagaatgccgtacctactgtcacggtatgccacaccgcactgcttctgtctgaggaactcccttcacagcaaagaaagtatggtaacgagcccatgctcatggaattccccggtacgaccatgttgcccaccatcttgaagcagctggtttgataagatggtggaatggccttttgaagactccactacagcaccagctgggtggcgatgccttgcagggctgggccagagttctgcaggaggcagtatatgctctgaatcagaactga

SEQ ID NO: 108325 - DNA, 817 bp, Homo sapiens
ctgcaggaggcacgaggggatttttctccattattcactgtgagaactcggggaagctccagaaggtgagggagaggggacaacgacatggttcccgtggatctttaacttccagacttgcccgctctgcgcctccggcactctggtgatgacagctcaggtttccctgcctgtcactgctcgggcagaggctgctgcccagggcttctgctccggtaccttgtgaagctgcattctcctgccggtttctccagttctggggacagtggtttgctctgagacctcgcttcctttatggatccaaggagacttgctttttcagtctgttcagctttttacttgctaggatggaattgcaatttgcaagcttcttcgacaggaaactacaagttccacactttaattttatacatataaatatatacatgtgtacatatatctatgtaaaggggtattatatatatacatataagatgatgatatatataatgatgatatgtattactgagaacgtaaaatatcattacatagtgatagctggacacacaaggaattcacaactccccaaagaaaatacatctggatgacctgcctagcagtttccccatgagatagaggaatgtctacgtatttcattccctgttcctgccctgaaacaatttcaatcactgacaaatcattatcattcattaataatgtttactgagtgcccatatgtgaaagaaatccactctacattccacagatgcatttcctctccccacggggtttccattttaatgggaacaatgtagaatatatctgtcttccctttata

SEQ ID NO: 108326 - DNA, 265 bp, Homo sapiens
gaaaacagaggcacagacatttttaagtttgccatagtcacacagctattaagtagcagaattgaaacgaggctctaagtacgttaaatccagatcccacatccacaaccattattcactgatttctggatgagattacctggagggtctgtgaggataaggaaaagagcaaacataaccctggaaaacagcaacattcagagttcggaagaagtgaaggagcaaaccatggaggctaaaaagaagtatctggtgagtaggagga

SEQ ID NO: 108327 - DNA, 807 bp, Homo sapiens
ctctcattgactgaaatgtccttatgcagcacatgactgtatatggtagaatctccatggttatgtaaagctcctttgtaaatgcaaccttgataatatcttgataattattcagtaaaagtgtgccaaaaagtgcttttttgtttcataccttttggagaatggaggaaaaattttaagagtgacactttgtagcttaaatatattatgtgggcaaagttttttaaaggcattatcacttctgaatctgacctttcagatggatcattaaaagtgcggccgggcgccatggctcatgcctgtaatcccagcacttttggaggccaaggtgggcagatcacctgatgttgggagttcgagaccagcctgaccaacatggagaaaccgcgtctctactaaaaatacaaaattagccaggtgtggtagcacatacctgtaatcccagctactcgggaggctgaggcaggacaatcgcttgaacccggaaggcggaggttgcagtgagccgagatcgtgccattgcactccagcctgggcaagagcgaaactccgtctcaaaaaaaaaaaaaagtgcagaagactcatagagattgatatttttctttgatttgcagatagctttgcaattccaaagtcaatgatatgttagtgatgcctttgtaatatttgtcaatccccaggattttcctgttatcagatatctttaatgttacattttaagttcatttgaaactggccacaagataaaaggagctcataaataagtcatgaagctttgatttttctccatggaaacttttcctcaat

SEQ ID NO: 108328 - DNA, 511 bp, Homo sapiens
tgagatagagtctcgctctgttgcccaggctggagtgcagtggtgtgatctcggctcactacaatctctgcctcccggattcaagtgattctcgtgcctcagcctcccaggtaactgggatcacagacatgtgccaccacacccagctaatttttgtacttttagtagtgatgtggtttcaccatgttggccaggctggtcttgaactcctgacctcaggtgatccgcccactttggcctctcaaagtgctgggattacaggtgtgaggcaccacgctggacctctgtttgcaactttaaatgtggtatcatttaaatttccagtgttataataggtgatgacagctactatttactgagcatctaccatgtgccaggtgctttacatattcatcccatgaaattctcataacaacctataaagtattaacatcccagtttttcagatgagaaaactgaggtttagcacactaaaatgacatgcccaacatcatacaattaactggcagaa

SEQ ID NO: 108329 - DNA, 111 bp, Homo sapiens
tggtggcaaggggaaatgccccttgtcttgtccaccctcattcgtccccttccctccccagtaatggccactggttgccctaggaaccacccaggctcttcccagaggacc

SEQ ID NO: 108330 - DNA, 726 bp, Homo sapiens
aagggacacagagcaaagaaattgtttcattggttaaagtttgagtgtttgccttatttggactatccaagtgagaaatttatgacaatataaccaatgtcccagttagccaactgtgattggctaaactaagtttcattttcctcatgagggtgttacagctacatcagtctaatggcctaccaattattttaacacttgagaagcacaatttatcaaaactgattaaagattaaaagtcagaatagctttatatctaattgagaaattgaattcattataaagaatcttcaaacaaggaaaatgtcaagcccaaatggttttattagtgaattctgttaaacatttaaggggaaaatgataccaatctgaaacaaactcttgctttatgagactagcataactctgatatcaaaacctgataaacacattacaagaaaataaaattattgactaatattcctcatgaacacagacacaaaagtatttatgaaaatactcatttggtcatgatatagcatcctttgtatctaaaaccaaatgagatttatcccaggaatggtaggttgggtgaacgttcaaaaattgatcagtgaaatttggtatgttaacagaatatatgatcacctcaataaatgcaggaaaaaacatttgaaaaattcaacacccatgcattataaaaactcagcaaactaggaataaaagagaacttcatcaatctgataa

SEQ ID NO: 108331 - DNA, 704 bp, Homo sapiens
tcttagtgttttatttgcatattatatgttgtcactcattgtatttgaaaatagcattaataatggcaattttttaatgttccagtacctgaaaagttcagtggatggcccattgctcttttctcactgcatgttgttaaacatttttcttttgttagtgatttatagccattatttgcagagcctgtcaatttttgacaatttttgagccttgtagcttgctcatacctctacttcaaagagcaattggttttcccacttcagggtattgaagatatatcaagcaggcttagtttttaacccccttaagtttctgtttgaaattatttccagaaaagaatgtgcatgttggtttcttcttcatctactgcgttacaacttttcaagagtcttgagaataatcgtatggcctttgaaacaattgaattttgaaatgctttagcagaagttattttagaaaataacaatacatttttaatatttttctcattaccccaacctaatcaagttccaatttgtcttatggctttacctcttttgaagatataatctttggtatctaaatgtaaaatgaacatcttgggtgttacctagtaacaaacaggttaactaagaaccaagaaaatttttttctggaaatctagaaatggttaacttcagtttccttcatcttattcttgcttacctctgttaatttcgggccc

SEQ ID NO: 108332 - DNA, 584 bp, Homo sapiens
atacctgatggagaatgactgaatgtttgaattaaaagactcagggagaaggcaaagttgtgtttaagttgcaagttgaaaaaaacaatccattggctctgttagcagctattagagaggttggggcgggagcagagtctgtagcttaactttgcttttgttatgtcgatgctatgagcgtgggaatcatggaaactgtgaataaatggaagagagtctgtcagtgacctactgctgcatcttgggccagcccaggcatccgtgagtgttcagggagacctcgggagagttctcaggcagaaactagccactcacatgcttgtcatctgcggggttgacatggtgggctatttttatgctcagacacttgggagaaagggcaggctgtacccaaaggcagataagtgctggccagatgggcttgctgggcaccgtcgaactcatggtcaccgtcctgcccaggagctagaaatagaactagccccgggacaatccgtgaggtatcaggtgagtatggcccgatacatgtgactcagagacacaaggagtgagggtgtgtgctctgtctcaatgagagaagagag

SEQ ID NO: 108333 - DNA, 308 bp, Homo sapiens
tagtagagacaaggtttcaccatgttggccaggatggtcttgatctcctgacctcatgatctgcccccctcggcctcccaaagtgctgggattacaggcatgagctactgtgcctggcccatttggattttttttaaacaactaccaaagggactagtgtgaatattttctgtaagaaggtttcacaattgtatatgaatggatcaaacttctttttccccagagacataggttctgtcccttaaattctgacttaggaaactttaatatgttattattagggtgaaagttgtgaaagtcagatatta

SEQ ID NO: 108334 - DNA, 532 bp, Homo sapiens
ggctgcagtgtatcctcaggacagataggacagatagtgtatctttgggacagacggcaagatggggattccacccaggtctgtctgcagcgagttgatatgagagtttaaggaatttggaccagggctgctttgtttcagggttttgggcaatgacctaaacacctttatcagtgcctgggaatgctcaaggcccagcttgagttcaggcctgcagggaaaacctgcaactggccgggctgcagagtggtcagggcacggaaagccagaagctggggacacacctgctgtatgatccagccgttcgtctttacctgggagaaatggcaccacctggctgaacataacttcttacactcccatgagtcctcctggacaggtgctgtgacctcgtgcagccttggggaccctgacactcccacggacaggccaaggggtttgcctgggccctgtgggcacagagccccttgagatgggtttccctatgcagccccccaccccccaccggggacccatggcactgcagccctca

SEQ ID NO: 108335 - DNA, 486 bp, Homo sapiens
attttcttggtgtgttgccacgagataatcagtttggtacaaacctttttaattttctgccggcaaaggataagaatttagaaggcagatgaacaaattaataagtagatcttgatatgatggtggatagtctatttcttgggtttctgcatcggatgtgatgtgtgggtgaatgaatttaggacttttttgcctttttaaaaattcatgataggccaggtgcagtggctcatgcctgtaaatcacagtactttgggaggctgaggtgggtggattactagagctcaggagttgagaccatcatgggcaacaaggaaaaccccatctgtacaaaaatttagctggatatggtggtgcatacctgtactctcagctactcgggaggctgaggtaggagaatcacctgagtctggggtgtcaaggctgcagtgagccgtgatcatgtcactgtgctctagcctgggtgatggagtgagaccctgtctc

SEQ ID NO: 108336 - DNA, 287 bp, Homo sapiens
taataaaacgttgggaaggggatgaaattattttggaagttccagctatgtgcctgcccctgtgctgggcatttctcagttatatcctcatttaatcctcaacataaatttggagagtgagaaaattgaggtttgttgaattaacaactggatttcaaaaccagttttctctaactcaagcctttactatttggtactgctatattaaatcctgtggaatttaaggaaagtataaaccaggttttatagtagagtacttgaacattaattgaaaatggtctcctatc

SEQ ID NO: 108337 - DNA, 199 bp, Homo sapiens
cccttttctccctttggttagaaagtgtgtgtaggggttgcagcctggcactcagtgtcctccaaccctgggtctaaaggcactgggatggagttggaagagaataatacggcaggccgcccttgatgcaggttctgggaagcaaagaagctccactctacactgaccagcccaacgtgaagctctacactgaccttgc

SEQ ID NO: 108338 - DNA, 127 bp, Homo sapiens
gtgctgcagcagttcaccagagcacggaagtggcacatccgggactgagaactggcaaggccagagggcagaagcaagtcacacaagccagtggcccaaaatcacgtcatctacctccgttgcactg

SEQ ID NO: 108339 - DNA, 275 bp, Homo sapiens
gaagctccccctccagcaattttccctcagaacagtgaggacagtggctcatccctgcgacatttagatctctcatgttacagggcattctttcaaaaaaaaaaacaaaaacaaaaaaaacagaaatagtatacagtaggccaggcactgtggctcaggactgtaatctcagcactttgggaagtcaaggcaggaggatcacttgagaccaggagttcaaagctgcagtgaactgagtgcgccactgaactccacctgggcaacaaagcaagact

SEQ ID NO: 108340 - DNA, 656 bp, Homo sapiens
ctaaagtctgtgtcttctaactccaatatatggagcccttgtgggtctgtttctctcctatcatttctggtcatttttagtcgctttttttgcctcttcatgtgtcattatgtactggacacctaacaaataaagagaaacactatgttcatgggttagaagactgaatactgtgaatccatccttgcacattgacttacagaattaatgcaatccacatcaaaatcccaagcaagcggttttataaaaactgacaagctcattttaagtcatatggaaatgtaaagggcctgcaacagccaaaatatatttgaaaaagaacaaagctaaaaaactgttgcaacctgagttcaggccttttataaagctgtagtaatcaagacaatgtggcattgccaccaaaatacacaaataaatcaatgaaacagtactgggagtccagaaatagatccatacatccatagacaactgatttctgacaaaggcaaaaggcaattcagtaggaaaagcgtagtttttcaacaaatacaactgaaacaactggacaatcatgcccaaaaaagcctttcaatctgaacctcccactatatataaaatttaatcaactggtcatagatatacctgtctaaaactataaaacttctataacagaacat

SEQ ID NO: 108341 - DNA, 288 bp, Homo sapiens
cacaggcgtgcaccaccacacctggctaattttagtattttttgtagagatgggttttcaccacattgcccaggctggtcccaaactcctgggcccaagtaatgctcccatctctgcctcccaaagtgttgggattatagatgtgagccaccgtgccctgctcaccacccattctttgagtgaaaaacgcagcagtctgtcctgtcagctccctggtttggagtttacccacagcacctgccctgacctgacctccaggtatacaggtctcctgctacaaccgtccct

SEQ ID NO: 108342 - DNA, 444 bp, Homo sapiens
attacacattgggtgcagtctacactgcttgggtgatgggtgcaccaaaatctcagaaatcaccactaaagaacttatccatataaccgaacaccacctgttccccaaaaacctcttaaaataaagcaaaaaactgtcaacaatttctaagaggtcaaataggtttcaaccatattgtctttatgtgaggcttcagtctatagaacatatgcattaatcatagaaatatggaggtggcataaaaattaaacaatatagaatgtttaagtaaatgaacaaaaaatgaaatatataggctctgtatttacagtgctggggttcaaatctctgctatctgtatgaccttaagcaggctagttaaccttactttccttatccataaaatggggataaaagtggctcctaccctcacagagttgctgtgaggattaagctaatacatgt

SEQ ID NO: 108343 - DNA, 395 bp, Homo sapiens
ataaatgccaaaatattaatgcctttcacatccttttcattttgaatacattccgtattcaaagaattctttacatttcctttttaaaaatcaactgtctatgttcttgttaggaatggaggaagtatcccagtgtccccttaatttatttccatttatttatttattttttatatttatttatttattttttgaggcagagtctcgctgtgtctcccaggctggaatgcagtggcctgaatgaatggagaaagtatcccagtgtccccttaatttatttccattttatttatttatttatttatttatttatttatttattttttgagacacagtctcgctgtgtcgcccaggctggagcacagtggcctgatcttggctcactgctagctcca

SEQ ID NO: 108344 - DNA, 487 bp, Homo sapiens
actgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcagctctggtgaggacagtgggatgctgcctggatactgccaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcgcagagacctgctgtcaacccccctcattaaaattcatgtgcctgcta

SEQ ID NO: 108345 - DNA, 802 bp, Homo sapiens
tctaattaaggcaggcctgaatgagtttgagtttgaattgggttaatatagggtcaaggaagattgcagattgggatgcggctggagctgaggcttgttgggcttatgtgaaatagggtcaggttattgataagaaacagggtctgtgtaatgtgagtgaatcctcttcgttccctaatattacaggtgatcatgtccttttcccttcatccctagctctgctaggtgggacattaattagcttcagttgattccaaagtaaggagtaggaagttgggggctaggaagacagaagggtgagaagtccaaaaaaggctctcccaaaaacttcggagctctcagttggaaccattgtctcagttctcttccctctcaaggtctcttctctcttttcctgggactgggtctggcattactcactcagctggctttcttctcttcttccctgtcctcctgttcctcctctgccttgtcttttctctccgcttgagggatactaacatctgcttaattgttgttcatatgccccaaagtagagtgttggatggatggacactgccggttgttgtgcaaagatggtgaagacagcatcatacgctgccgaaatcgtaaacggtgctgtgttcctagtcgttatttaacaatccaaccagtaacaattcatggaatccttggctggaccactcctcagatgtccacaacagctccaaaaatgaagacaaatataactaatagatagaaatgactttgtttcaggttgcttagggtccacatttcattaaaactcacaaatttgaaactg

SEQ ID NO: 108346 - DNA, 447 bp, Homo sapiens
actgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcgcagagacctgctgtcaacccccctcattaaaattcatgtgcctgcta

SEQ ID NO: 108347 - DNA, 524 bp, Homo sapiens
actgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcaggattgcagtaaggatgaaatgacataataatgcaaagctctggtgaggacagtgggatgctgcctggatactgccaggcaaacgccacatccttcgatgcatgggtaacagtggaatttgtagggcctcttgcaaaaagaacgaacagccctacctctattgcagaaattgtcagtcctgctgcctccagtcctacatgaggataagcatttctggcaaagaggaaaataccgactggtcttatgagaagcagtggccaagactaccttgagtgctggtgattaccattctcaagctctctgggcgcagagacctgctgtcaacccccctcattaaaattcatgtgcctgcta

SEQ ID NO: 108348 - DNA, 594 bp, Homo sapiens
actgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcaggtaacgtgaacctctctcgggggtctgggttcctggtcatgggcttcccgtctttcccttccctctcactgtgggcatcatctgaagcctttccttctctcctgcagcttcgggaggtttgcccaggatcatctcaagttaatatctctctctgattcttttttgccagagtggtgggatgatagatgtttggagcatctggtgcttgagggccagggtggtatcctggtgggagcttgggagaggtttgaggggcaaagcgtgggtgcaggttggggacttgttgaggacttcgggagactagagtggaagctggggtgagttgtgatgtggaggaaaaaccttgggattggagtgatagaaggaatattaggatgagctggaggtgaggagctgggcttccctgatggtttagggcagagt

SEQ ID NO: 108349 - DNA, 359 bp, Homo sapiens
actgcccacagccctgctgataaaagcaaagctcatctctgccgtgctgcagggaaccctatttccttcccctgcagctcagccacctcctcctctcaggtctgccagccatgaaacttctttacctgtttcttgccatccttctggccatagaagaaccagtgatatcagaaattgtcagtcctgctgcctccagtcctacatgaggataagcatttctggcaaagaggaaaataccgactggtcttatgagaagcagtggccaagactaccttgagtgctggtgattaccattctcaagctctctgggcgcagagacctgctgtcaacccccctcattaaaattcatgtgcctgcta

SEQ ID NO: 108350 - DNA, 329 bp, Homo sapiens
caatttgtctatgttagagatttttcctaaagaatttacaagtaaaaggatattttatccttgattgctttaaaatactctagtaaatgaacaaaaagtggtggggaggatagagtataactaagagcaacagaatgttgctcactgttgaaatggagtgataggtgcatggacacttcttataccattctctctgctttgtgtgtgtttgacattttccataataaaaaggtattaattccctcattcctgtctccccaagtgaagctttgagctaaaaaggtcaagtgttatatcaaataaaaattttaatataaattaaaaaaaaa

SEQ ID NO: 108351 - DNA, 415 bp, Homo sapiens
ctggagctcatagcccgttcctcagaatgttctctatcctttgagaattgagctctatgtcctttgaaaagacataatgagatgtctcatgttttgaaatatatgaaagccactcttagaaagcatgtctggttgataagatttttgattaggcttgagaagtagcatttgtttccaaagctgtgaagccattaagtcataagactaccttgtacactgaccttcagaagacaattctataagaagagaccccaaagtaccttgaacaacggcaacctcacaggaatcagtaaactccaggaacatcccaagttagccactttaatgtgatattactcatcagtgtggatggatcctatgtgtttgttaaaaatctggggccaggcatggtggctcatgcctgtaatcccaggac

SEQ ID NO: 108352 - DNA, 215 bp, Homo sapiens
tgagcaggtgtgagcaggtgtgtgcatgtgagccttcatgagcgtgtgtgtgagcgtgtatgcatatgcatttgagtgggcgagtgtgtgagctgtgtgagcgtgtgtgtgagcagacatgcatatgagtgggagtgtgcgtgagagcaggtgtgagcgagtgtgtgtgagcaggcatatgcatatgagtgggtgtgtgcatgagagcaggtgtg

SEQ ID NO: 108353 - DNA, 547 bp, Homo sapiens
gaacatcttaaatactacggacaaatctaacaatgttaatcactcaccagctcatgcccagtggtcatcaccagacccttaaaatcagttgctttctaggagtcctaggtcacttcctgctggaaatggcaacaattttcaccagcattagatgcttgtttataagaaaactgtggattttctgaaataaatgtgaggtcgatcaatgctataacaaagtgcttttcccgtggttaagctgaggttatgagtgctttagtgtggctccattgaccagcactaacttcatgaaaatatttagaaaaagtttttgaaaacatatttttttaaggagaagaaaacagatttggcataagttatatgacagccacagtgaggctttcttatatatgaaagacattgacaatcagtcccatggggtttatgtaatttgagaatatagctttaaaaatcatattacaggcagcagtacttaagattaatacagaggccatttacctttttattacgtgttttattagcacttagcagcttgacttatgaaaga

SEQ ID NO: 108354 - DNA, 479 bp, Homo sapiens
tgagaccagcctgttccaaactgcgaaaccctgtttccactaaaaatacaaaaattagccaggtatggtggcacatgcctgtaatcccagctacaagagaggctgaggcaggagaatcgtttgaacccgggaggcggaggttacagtgagcggagatcgtgccattgcactcagcctgggcaacaagagagaaactctgcctcactttaaaaaaaaaaaaaaaaaaaaataagagggagatactaaaaatgcagaagagaaaggagataagcaactagcatgtgggctctgagaaagcgggggccattggggtctagagcaaaagacaaatgattagctttagagaggaagaagaacatctctttaattgaaaaaaaccaagaaaggatggaatgggttggaggctgcttagcagatgtggtggtaggaaaccaaaggtgttcctaagtgttgtgaagtaggaaggactgtacattaaa

SEQ ID NO: 108355 - DNA, 282 bp, Homo sapiens
aattcatggggtagtgtagaggcctttctatagggatgcaccttttggatcacctggaggggagattcatttctcttgtttgaagttttctgtttgaaaatttaaaacagaccaggcgcaatggctcatgcttgtaatcccagcaatttgggaggccgaggcgggcggatcacttgaggtcaggaattcgagaccagcctggccaacatggcaaaaccctgtctctactaaaaatacaataaatagccgggcatggtggtgcatgcctgtagtcccagctac

SEQ ID NO: 108356 - DNA, 337 bp, Homo sapiens
ctgtgtgtgtgtctgaaattgtccatttaaaaaatgaatcagtgttttacagaaatcagaagtacttgttttcacaaatcagtaccctttcttgaaatctcatctcaaaatatcaacttaaattcgaatttaaacttgttttattactaaccaaccacttcagctgagccctgcggtgtatttctgaaactttaatttgtgataagatttgataaagggtgaaaaaatacaaaggtcctttaaggtcttgctctcttacaagtcctttggggaagatctaactggtaaggctgtgcttcctttgtgttaatgacaagtgtgtcttcgtttcgtagct

SEQ ID NO: 108357 - DNA, 566 bp, Homo sapiens
aagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaa

SEQ ID NO: 108358 - DNA, 416 bp, Homo sapiens
gtttgttctctcctcgccctgcaaaagattcccctttacccatgagtgctcattgcttattagctgtggtatttcactgggcaatctctgggtatagtgaacttacgggaataataataaatatcacagtgctaaaatggttaatattctataagcaacaagggaaattaaccctgaagtgcacagtaccttaagaaatgataatggcaaattctaaaatgaacaatatcatgggattaaaaatcaacatggagacgccacagtaagatgcaacttaacgttagatccatgcaacttgcaggtaaaaacaaaaccgtttattaattcattcaaattgtatttaccaagtgagaaagatagagatgttaactatttaaggtctagttaacataaactaaaaagctactggacttcta

SEQ ID NO: 108359 - DNA, 628 bp, Homo sapiens
tgaaaatggagctcagaacattttccatgttagaagccgtgtagggcagaggggatagtaacactcttttctgtgtggttgaactaattctactcaatcaattgctttattcaaatagtcagtatgaataaacaaatatttatttagcagctatttagttggccctcagcaaatatttattgagggccgactctatgccaacattattagatctaataattagatctaataacaacattattagaaaaccctacctagtcttccactggcacacacagaagagaataattaggaagtgaaagagaagtcgtaaactgaagaatgaagccatctgatgatgacatcatgctatttgcacagtgccatgttttcccaggctcattgccttgagaaaatgcttcagctaccctttccttatggagatttaagtcctaattcaagacattaaggaattaggaattcaaatcccatatttctccatccttgttcatgttatcgttagcttttgaaaaggaagaatgattggccattttagtcattgtgtcagtgaaaactctatggaattggtgtttttttaaaaaatatatgacaccctcatttttaagatatacagcttttatgcattaaa

SEQ ID NO: 108360 - DNA, 560 bp, Homo sapiens
gaaacatggaggcttagtttcccaccccctccaaaagaagcactttacttatgtactcacatattttcggtttctgtggctgtgttactgggtagctgtccagttgagacgagatgtttacttaagccacacccagcagagtcagcttttaatgtgttgggggcactattttaatcctgtgctgatttgtaaccatcatctatgggatgcctttgagttgtaaaaagagggaaaatactagattcacaggttgcagcttactatgtttttgaatatttgagttgctgtattaatagcacagaagagcagtatttaagttatgcagcatttatctatggcagagagagatagagaatatgtgtatggttccattacaagtgtaatgcaagtattctgatcatatagctaaaaatgctgctggtatattattttagttagtgttgtgggtagtaaattggagtatgacattcagagttcagattttcttatttgagaaaatatttgtccaaacattttaaatacttaatttttctgtgcttttaaaagatttgcaaaggatt

SEQ ID NO: 108361 - DNA, 517 bp, Homo sapiens
gctgtgcaggatttagggcaaataaaaggctagaaaaggagatgttaggtaaattctcactggtctaacagaggcagactgactacagtgagtccaggagaactttctgtaatgatatgaaatgccccaaatgctctacctttgtgtggtgcaatacacgtggctacagagcacttgaaatgaatgtataacagctagtgccactggagaaactgaagttttcattttacttaattttcttttttaagagatgggttctcactctgtcacccagtctggagtgtggtggcacagtccatagctgactagagcctcaaactcctgggctcaagcaatcctcccacctcagcctcccaagcaggtagaactacaggcatgccatcctatgcccaactattttaattcttttgtgaagacagggtttttacaaaaccctgttgctcaggctggtctttaactgatgcctcaagtgatttcccacctcagcctcccaaagtattgagactacaggtgtgag

SEQ ID NO: 108362 - DNA, 93 bp, Homo sapiens
ttggctggaaatacatatctttttaagacaactgtttgtttatttcccctgtgggaccccatgccactctcacccctcaccaggtagacttct

SEQ ID NO: 108363 - DNA, 378 bp, Homo sapiens
tgacctcaggcaggccctacacctctctggaccttggtttccttgtctgtaaaatggaggaaggctagaatggctggtaaatgctcagctctgtgagccatctgaacctgctttgtttcaccagtgaggaatcacccataatggggggagactagagccactctaaacctaaagcagggttagatggtacatggagctgagcatttgctattttaactttgtttactttcatggatatatttcatgtgtatattttcacatatatgtgtatatgtatgtgtctgagcgtgtatgtgcatggtatttgactagtacatcagaccctgatttcacaaatatggctaaagacgaggctaaaacacacacttaaattttaaa

SEQ ID NO: 108364 - DNA, 303 bp, Homo sapiens
ccaagtctgctccagggccagctgagcacacagtcaggtggcctgctcttctcttggccacctgctgaacctttatctactacctaaacctttcatagacccgcacaaaaggcagactgcagtgtggttaagagcgaaggtttttcaagatctttatctgtgttcctgttcaaactccagctctgccagtgcctctctgtgcctctgttccccatcagtgagaggcagtggcgccttccctgcagggttactaaaggtttagaggtcacatggggagagcaggatagtgtggagcgtgaaggt

SEQ ID NO: 108365 - DNA, 386 bp, Homo sapiens
atgaaaattaaatatatagtaatttttttattctacaaaaacattcattataagatttctgtaaatgataaatttctcccttgcacataagatttttgattaaatatagaaatactctattcttctccttttataacttttggttatatatcataaggctaaatatcttccctgctgaattcacttccccaaataaaatttattgtggattaaaggaaataccagacaagagtagaagattctgtgcaaaaatgaaaatgtaattttttttttaattcttaaggaacggcagtggagtgtccttggcttgagcatttttttttagaaggactgcaaatctgattttagagagctgatagtatcagaaagtagaactgtgaataaga

SEQ ID NO: 108366 - DNA, 803 bp, Homo sapiens
ggtctcagttttacaggaggaatagaaaatctaccacttgccatctggaagatcaaagtatttccaaatagaatttaagtcaataccacacaaattctaattccctagaagcagcagttttaattttgatagtctctaaaagcaataacatttggtagtttctgagtaaattttagactctcaagggtttagttttagcagtttaataaaatgtgaattttgtctgctgagaagtgaactttgtggtaagacttggcgagtctgaggtctgtggtactccccctttggccttcagtgggccatgctcattcccttctttcttctttctgggcatatttgctgcccagattctgcagtaaggagagagtggctgccttggggtgattattaggtgaatactcaggtctggggttgggagggacctcgtaggaaccaccaaaatcgagcctttaaggaactgccgccttgtagttgcttaactgtacaggatttcccccgcaacggtccccttcctaacaggctgctctacaaagccaggcttggactcataagaactcagaggtggaccgttggaggccctgcatgccttcctctgtcacgtgctgcccctggcagctcggtgcttcttgccatgggcctacctggatccgccactcagcagtgaacagccgaggaaggtagtggacgtcgaacctggcccgtgggctctaccatggcatggtgatgaaggcatgaactttggcccacttggcctgtcctggcaccagccaccccctactcacaagttatttcctctgagaagc

SEQ ID NO: 108367 - DNA, 439 bp, Homo sapiens
catttctatctaagcaagaaccattttgccttttaaaaactaaactagtagtctattaacgatcaagtccagaagggcgtgcccaatctttctaaagacatacagagaagatgatgcaaatgtaacagaactgtgttaatgtgctctgctcagatttgtggggcccagtagataacacacaagcactggagcctttacccactacccttgagcccaagctctgtccctaaagactgtatgcttgtgggtaggcatttaacatctctgaatttttttcttatctgtacaatttaagacagcagtatttcttcatatacgtgtatctggggataagaaaaaaatgtgtattgaaccctatgatagacacttggtaaacgatggaaatgtaccaggtatatatccagcatgtatatgcatacactccagtgagtggtctttc

SEQ ID NO: 108368 - DNA, 467 bp, Homo sapiens
ttgaaatcttccagcaacatcaaaagtcagaatgtctctagaaaccaaggattaaatgaaaaggaaaagatgacttgtcctcaaatccaaacactatttatgcctgcatgtggactcttttgtacattttagctcatatctaatgcaattttaacaggcctgtttatctcattttctagctcagtgaagattagaagggaggaatagactacacagaccaaatgacagcagtgaaaagtgatagcagtaggaaataataaccaatatcatggtggtgggcagaaatcccaaaattacctcctcctctccacacacacatgcacagccaatccaaccagtataatactatagaggccctaaacaataacttcaatatagaaatcaaagtgcacagtaatttgggaatacttaatacaaagcagctccaaatgtgtctcacatccttgagaatatcaccatagtataga

SEQ ID NO: 108369 - DNA, 511 bp, Homo sapiens
attaatgtatcaaacctgtgtactgatgaagatattttaaatagtcttttttttgtggagggcagagaattgtgtaacttttatgtatcccactgccttttttattgtgtattgtgaacacaccacagcagaatttaaatagttaaatatttgttgcctcattaaattgtggcttcctaacttaacttcagattgcagaggactagaaaagtaggcatttaatatattattttattttacgagttttcttgatacataattggttttggatatatttcctcctaagtacagagctagcaccataaattacaagcagtaaccagatctttttatatgcctcactttatattgcttaggcaaccttctgtatgctgttttctctagtcctctccatagcagttaaacctgaactctcatcagagaagtaaaaatttcctgtaaaatgagttgttaaaagctatatgtttgaagtgtaagagcaggcccttctaatgtttaggagttagcttgt

SEQ ID NO: 108370 - DNA, 309 bp, Homo sapiens
ggtcaatatagcaagaccccatctctacaaaaaatttaaaaacttagtcaggcatggtggcacacacctgtactcccagttgctctggaggctgagacaggaggattgtttgagtccaggagttcgaggctgcagtgagctgtgatcataccactacactccagcctggaagaaatagtgagaccacatttgaaaaaaagaaaaagttatgacccaccacattgcagcattggctcctgcagaaagagactggaaactgcctaaatgttcatcgatagttaagtaatggtacagccatatcatggaatg

SEQ ID NO: 108371 - DNA, 204 bp, Homo sapiens
gtagtttgcctaagatccacagtagagtctgactccagctcacctgtgctgtgctgcctccatttatcaccaaattcctttctcttctgttcccaagtcatttccacattcatgctttatttccctctgccttagttcaggacaccattctctcttcagtgcaatactcttctaactggttttcctgacatgcattgcctcttg

SEQ ID NO: 108372 - DNA, 540 bp, Homo sapiens
acctgatgttatacaaaccttagacactgaaatgcttaaggattaaagaaaacactaatgtctaaaatgccactcaaagcagaataaatctgcagctggaaaatctgacctttagccctgaatctgcctctaataagctgtgtgatctggggctagttagtaagtcactctgaatcccaatttctttatcagcatttggacttcctacttggggtgcctatctctcaataggcagaaagtgaggtagaatgagattaaggatgctgggcacagtggctcacgtctgtaatcccagcacttttggaggcaagggtgggtagattgtttgagaccagcctgggtgacatggcaaaaccctgtctctacaaaaaatacaaaaattagccaggcatggtggtgcaggcctgtagtgccagctacttgggaggctgaggagggaggatcacttgagcccaggagataaaggttgcagtgagctgagattgcactgctgaattccagtctgggcagcagagggaaaccctgtctcaaaaaaaaaaa

SEQ ID NO: 108373 - DNA, 452 bp, Homo sapiens
ggatagagggcactccatctagaaggagtcttagagttcatctgggccaaatcccaggccacgaggttaagtgagcagtccaaagcacacagacgtctagtgacagggcataccttggaccctggactcctgagtcctaagccctctctttacttgctcttccttgtattttttgacctgctccgtttctgtcctgggccggttcacccctccttaggcaacctggtggttccctgctcccaggaagtcaccatattgatgccaaacttagtgcggacacctgatgggcatagcacactacaacccagaactcctgggcttgaacgatcctcctgcctcagcttcccgagtagccggaactacaggcacgcaccaccactccctgcatacttgtagttttttctattacctttaaaaaaagtttagatatctgataatcataacttaagcat

SEQ ID NO: 108374 - DNA, 403 bp, Homo sapiens
tggacatgtgactttaactctctgtgcctccatttcctcatttgtaccatatgactaaagatataccaatatatggctaactaaatgagataaaatataagtaagctgcccagtccataataggtaatatgtaagtgctgttgctgtgttgtagctgttgttgttgacagaaaaaaaaattatttcggcagagacatttttatctaagagatggcgtatttgagctagtcactgatagatgaaaaccatttcaaaagatggaagttgggaggttgaagaagtgcaggatggcattccaagtgatgggggcaatggcatggaggtaggaaagcataaggtatattcaggctataaataatagttagatttggctggatcctggatttgagaagccaggaaatga

SEQ ID NO: 108375 - DNA, 193 bp, Homo sapiens
agccccttttctctcttctacagatcaaaataagcaaactttaatggtagggaattattgtttattttgttgaaatctagttctgagttttcctacttgaaacgtgttttccccaggacactgacctatcctttaattgtttggtgcgaggcatgttagggggaggggcgttacttgtttattggaacagcgc

SEQ ID NO: 108376 - DNA, 596 bp, Homo sapiens
gatcccacagctctgtaacttaataaaatagagcctggatatgggagtcgtcgcttctacttgttgagaagggaactccctttggcaagttacggtagcttaaggtttaacaagagaaaagaactgttaaataatctttaactatgtaaagttgtgtcctggagcctgaggtagaaattcctgtgggctgatagccagaacaattcatttacttcatacaaccccttgtagcttaaactcacaaccctctctgggccccatcgattggcgtctatttctgatcatccagaaaatgagaacattgtattttaggagaggcaccagggtggtggtgaagtatctgggcacaagaccagtggaagatatggttggaaaggcaggtaaaagatttgattaaggttttaggtatattttatcgaatggctgtaccattgtttagcttacaatcatttgtctctttacctttgattgagtctgtcctatttagaataaatgtacctacagttggagaaaaccagaaatagaaagattctttgtgtacacatttcatatttttgtttgtcctttcaacacacacacacacacacacacacaca

SEQ ID NO: 108377 - DNA, 862 bp, Homo sapiens
aatctcttcgttctgtgcacacgaattcttccttatttcacagacctagcttcagtgctggctctgccataagccttctctgatatgctcaggtggaaataataccacttatttcctataacatctaaaatgttgtatctgtatataaaggtgtaattctatcacccagctcacaatggctctgctctactacatttctaattaatttttaaagtttccagatagggcatcataataaaaagtgaactggtaggtttatatatttttacttgatgcatctcagaatacaccagtatactgagaagatgaccagataggactcatagacctaaattctagttccacatctctgttaaagcttagataactcaagatctcttagccttgtttcctctataaaagaaaaaagttcagccagatgtgatggctcatgccttttagcccagcactttgggaggccaagatgggaggactactttaggccaggaattcaataccagcctcgatgacataaggagaccccatctctacaaaaaataattttaaaaaattagctggctgtgttagcacacatctttggttccagctactcaggaggttgaggctggacaatcacttgagcctgggaggtcaaggctgcagtgagccatgattgtgccactgcactccagcctggttgaccgagtgagaccatacctcaaaaaaaagaaaaaagacattgtatgagatagtttcaaatgtaactttgaaattacaaacaaagcctacctatataaatgctttagaatgggaggcagcaagattcaaaggaccacgttattgttggctttgctgaccacacggtgtttgttgcaactaccta

SEQ ID NO: 108378 - DNA, 137 bp, Homo sapiens
gtctccatctcctgacctcgtgatctccccacctcggcctcccaaagtgctgggattacaggtgtgagccaccgtgcccggccaagaaggacatatcttatttaatgatctccagcagtgaactccttattctaaac

SEQ ID NO: 108379 - DNA, 637 bp, Homo sapiens
ttgcaaagggttgtaaaactttattgtgattattcttgctttaagctgaaacatccctaatctttctttagagattgtggcatagcatgttagtttcttttccatatccaattgttttctgtaatgaatacagaaatacgggcactattttgtaactttaaatagacatcatctcaagtctacaagaattatccaaaatggtatttaatgacatttctaggtcttcagacactattaatgcagattgtagcctctaggtcctgaagattttactagatactggttactgaaactgagctttcttgaattctttttccttccactgtggtttcccgcatttcaacatatcacctatttttgtcctcaaaggttacttaaatgttttccacagaattaaattaaatatgaatcatccctcctctgatttttgaaatgaccctttgcttcctatgataatgattcttctggtccgttttgtagttatatgttagagtttgtaaatagtcacacattttgcaactgcatgtaattttcttattattttttcctcttcctctaaaactgctgttatttcttttaactttttgtgggaaaaattaaacccatctttcactttgttgatatgcttatttataat

SEQ ID NO: 108380 - DNA, 383 bp, Homo sapiens
agtttcccaaaatgtttataactacgattcaatagtcaggtgaagccttttagttcttcttttgagaggtgcttaagatcatcttttcatagcaatgagaatcaaagaagtctgggagagaaaaaattgccattttacacagtgctatggggagctgcagacattgattctgaactaggatgttttaagagtaggcttgtgaacatggtcttattctaggcattgacgaacttctgccctagacaaaggctatttctttaccctctgaacatcgataaaagttttgaaaaattgaaaagaacctagcatctgacagtgatgaccccagtggtcagaagatacatgcatgtaaagccatcagcccaattagtggacataaccct

SEQ ID NO: 108381 - DNA, 652 bp, Homo sapiens
cagttctgcctatatagaaacccacagttatctgagggaatgctctctgatactcaataaaagccatactcatcaatatccagatataaggcccaccatatgcagacctgactacaaaaacataccctagtgttttaactacggagcaaagccctgaaggatatgcagtctgtccaaaaataaaatgagaagtacaactacccaagcccctgtaacaagccaactaaaggtggaccctagtgcagacccagcagccttgtcaccaagctacaccccctctccactacaaattcagagggcatctcatcaccctaagggcccaacaaaagatctttaccttctaaaatcagtttataaaaacttgaaggccaggcgtggtggctcacacctgtaatcccagcactttgggaggccgaggcggatggatcacgaggtcaggagatcgagaccatcctggctaacacggtgaaaccctgtctctaataaaaatttttaaaaaattagccgggtgtggtggtgggcgcctgtagtcccagctactcgggaggctgaggcaggagaatggcgtgaacccgggaggtggaggttgcagtgagctgagactgcaccactgcactgcagcctgggcaacagagtgagactctctcaaaaa

SEQ ID NO: 108382 - DNA, 395 bp, Homo sapiens
ttcttcaatctataaacttttaaccatggcttaagtcatccattcctctaaatcagtcctgcctttcttgagactccacattcccagcatcctgtcctcccattacactgagctctcgcgtctgcatccacccacctgcttctgctcactctcctacagtgcccacatccttttcacctaggcagcctgtcctgacacaccaaactagacaagcagctgcttccttgtggaagtaggcctactatgcttgcaccaatctgagggtttctctgaccaaaagaaaaaaaaaaaagccctccaatagaagaatctgtgattaatgggtacaagcacagttcactttgcatgccaatggccaatgagacggtgggtttttcagacccagtggcacaatg

SEQ ID NO: 108383 - DNA, 371 bp, Homo sapiens
gttatggtagcctaggaaactaatatgagccttactaaacactttaaaatatggattcaaagaagtactgacctagctgcaattcaacacatgtgaaggaaagattcatctggcaacagtggatggatgtccttagtagggacccagataatcttccagctcagagtaactggggctcaagccagtgtgaaacaaatctgaaccctacaaatgaccttgggaagttggatcttgactacacacagaacaactggccaggcatttcacccttgctatgatctactatgtcaggtaaaacagtggcatcatttccacaggatcctgttgaggaaagctctgccagtcagagaaggggctggcacaaaggacta

SEQ ID NO: 108384 - DNA, 455 bp, Homo sapiens
ccaaccatccacccagaacaagtttaattatccacataaaaaatattcagggattatgagcatcccatattttcaacatcatcctgtgaagaaactagctggattaaggctatcacaaaacaataaactggcattgctgtatgtcagtttttgccaacttgacctgtggattcaatgcaatcccaatcaaaacccagcaaagtattttgtggatcctgacaaactggttctaaagtttacatggaaaggcaaaagacccagaatagctggcacaatattgaaagagaaaaaggtcagaagactgatattacccaactttaagactcactataaagctacagtaattaagatagggtggtaatggtgaaaaaatagacataatcactggaaacaaatagggagcccagaaatagccccacacaaatatagtcaactgatctttgacaaggaagcaa

SEQ ID NO: 108385 - DNA, 396 bp, Homo sapiens
gacgtttaagatgaaacttaagagcaggtcgactgggatagccagcccaggcttgatggcaagagctcacagggaatgttccaggggcagcagaagaacccctgtgctgagcatggtgaggagggggaagcgcagggagagaaaaggtcagtgaggctgtcaagggctacactgatcgggcctgaggaaccaaggtgagagctggattttattctgagtgcaacgaggatgtccttggaggggtgtgaagcaaggtgaaaggtcatgtccaccttgtagcctcaggaagtctcccctcaccccacttccacctccattcttctctagggggccacgactgggtttgaaactctaaaccctagttatgaagttgtaaatataagtaaaaaagaaaat

SEQ ID NO: 108386 - DNA, 782 bp, Homo sapiens
tgaaagactctttttctgagtagcatgacatttctgcaggcaaaggaagtgagtatagactcccaattctcttcttttccaggatgtacactagaatctgaagcatcctcttcaccctcgctccccttcaagtttccgaagccactaagttggcaatgaaattattttgtttatgcaaggagcaaaatcacatgtcaagctgataaataatgtatgaaatatcatttagttaatttcaaaggcgccaagactatgacaccattgcatccattcagatgaaaccttggttctccctgtgttaggggagagatctaaatgaagtatgtcctttatatttagatgactagatctgtggccctcctggcttgtttttcagggcccttaatactgatcagagaaatttgctatcacaaaatagctttcaaaacagaacagagctttttcttattgttttcattccaaattacctgaacctcagctttgtctgatcttttcaggagcaagaggttcacacattgcattcacagtatgcctacaaagagctactgagttgtttttaatgcattttatgctacagccaccagtggccaaattataagccagaattctgttagtagcatggcaaaaatctctcattgcaatgtaatttgttatgagtagataatacaataaaactgaagtagttcttcagtgttgaaattactgagtttcttttaaagtgtgtgtgcacatgtgcatgtactaaggttatggctagatgtgatgtgctaacatcccaaaaa

SEQ ID NO: 108387 - DNA, 396 bp, Homo sapiens
tagtaccctcctttgagaacacaattaaaaaaaaatcctttccttattgtcaaagtggcagtgttcttaaaccagatcatgagattgcccctgctcaaaatctagagtagtttcccatcgcaggttttttttttctttcaataatttcagcttttattttagattcagggagtacatgtgcaggtttgttacatgggtttactccatgatgctgagatttggggtacaattgattccatcacccaggtagtgagcattgttctcaatagtttttcaaacctttccccgctcctttcctccctcttctagtagtccccagtggctattgttgccatctttatgtctattgtacctactgttcagctctcacttgtaaatgagaacatacggtatttg

SEQ ID NO: 108388 - DNA, 256 bp, Homo sapiens
caacaaagcatggacttacgtagatcctgacaaaaaacaaatgcattaggctttgtaggtcacattaacgactgttcaatgaaatttgcacaaccattatatttcacaggtatccctgcactcacaatactgaagtcctccatctatagttggttggatgctggtgacacattccgaagaatgagtcagtgagatatgtccagactaacaaggtgttgctgtattactgaggcctcccccagatggtgattccttg

SEQ ID NO: 108389 - DNA, 447 bp, Homo sapiens
ataattcttattatacctgctgctctactactttacttggttttagtcgatttctgttggttgcaaccaagtgtgcctcaagccagtactctaatagagctctcctctatgttcagctcttctttatatatactcattctcgctggctaatctcatctgaacaaaagccttcattatacctaaatgttcatcacatacatgtgctactgagcaccatatcctagctttgcaaatacctactcaatatcttcacttggatatcccatagagccatcagtccaaacatcattcctcaaataatttgtttttatcctccttataattgttagcagcatgaacatcacccaaattaggactctgaacatcccttctctcttctttctcccacaccatctcaaataatttgccaagggctatgacatttgttttattcatagttgttaaatc

SEQ ID NO: 108390 - DNA, 320 bp, Homo sapiens
tctaactgtaatgcatacacacagtattcctaacgtatttgtagcttcatgtcattaaggaattttgcatattccttaaaaatggaagaaaaaggcattagaaaggtgttaccttacgctctgtcttgaactaactaaactatttaagtaacaaaaatatttatgtgttaggaggagcatgccagagactcatatctggataatttttctttagcttgtcattttttcttatttgccatgagagtatgatgacaataaaaaattcccaaccctggtcactaaagtaattaaagactatattctaactgacaactgtattt

SEQ ID NO: 108391 - DNA, 1163 bp, Homo sapiens
cttcccttttttctccctctctattcagctgtctccatcccccttttccgcctctctctctgcctttttgggaggcagccctgcagacatggttaaaactcgggcccagcctgactgtggttcccagctccagccctagtcagcttaacttctttgcattatggggcagaagtgggagcttctcccttccttccatcttcctctcttagatcagctggttaagagtccagcctgggtttggctcccagctccagcactagtcaacttaacttctttgcattgttgggcagaagagggggcgtctcctttccttccttcttcctctcttagaccagcttcccttcccttctggggctgccacagcacccggtcagcagaatccttgcctaattcctcttccttctccaaaccacagggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcactgtcctctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtttttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccagtgtggagagggggacctctaga

SEQ ID NO: 108392 - DNA, 836 bp, Homo sapiens
cttctccctcgagttgggacccgggaagaaccatgaagtggctgctgctgctgggtctggtggcactctctgagtgcatcatgtacaaggtccccctcatcagaaagaagtccttgaggcgcaccctgtccgagcgtggcctgctgaaggacttcctgaagaagcacaacctcaacccagccagaaagtacttcccccagtggaaggctcccaccctggtagatgaacagcccctggagaactacctggatatggagtacttcggcactatcggcatcggaactcctgcccaggatttcactgtcctctttgacaccggctcctccaacctgtgggtgccctcagtctactgctccagtcttgcctgcaccaaccacaaccgcttcaaccctgaggattcttccacctaccagtccaccagcgagacagtctccatcacctacggcaccggcagcatgacaggcatcctcggatacgacactgtccaggttggaggcatctctgacaccaatcagatcttcggcctgagcgagacggaacctggctccttcctgtattatgctcccttcgatggcatcctggggctggcctaccccagcatttcctcctccggggccacacccgtttttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccagtgtggagagggggacctctaga

SEQ ID NO: 108393 - DNA, 245 bp, Homo sapiens
  misc_feature (11)..(11): n is a, c, g, or t
ggccggctagncagatcccagatccttaccttaatcacatctgcagagtcccttttgccatggaaggtggtgtattcacaggttccgtggattagtatgtggacgtctttgagggattattgttcagcccaccacaatggtcaagggctgttggggcctctctgagagtcctctgatgtctgcaagctctgggtcctttctgtcctgcaagttctccctcctttcacgttggatcagaaggcctg

SEQ ID NO: 108394 - DNA, 289 bp, Homo sapiens
agaggatccctgttgctaggctggagtgcagagtgagacaaagggagtcaaggacgcctcccagaggaggtggcttttcagccaagccataacgatgcctaggagtttagatataacggcaggtggatggaagatgtggcatgtgaaagagcatgacctgacctgggctgggcacgctggctcacgcctgtaatcccagctattcgggtggctgaggcataagaatcgcttgaatgcaggaggtggagtttgcagtgagccaagatcacgccactgtactccagcctag

SEQ ID NO: 108395 - DNA, 354 bp, Homo sapiens
atacttggctaattttttattttttgcagagacgaggcctttctatgttgcctaggatggactcaaactcctgggctcaagctatcctcctgccttggcctcccaaagtgctgggattacaggtgtaagccaccgtgcctggccatggaattttaaacggtagctcttttctaaccgtatctccccctgctgccctgttgtagccctatttcagctagtctggaattcttactagtttctttggatttacaatgttcttaataatactggttctgcgtggaattccctttgcccattgcacttcaagtctctttctattgacatctatactcctccctcaaagcattatttatt

SEQ ID NO: 108396 - DNA, 390 bp, Homo sapiens
gctatattcagatacaaaggtataggtgctagagaaatcagagaattgtattaaccagaataacggttttaccaagggcaggggcaggcaaaggacctaatggtggaagcaatgattgggataatgggataatgacacataagacagaataggaggaaagagaggacatgaagtgggagagcaacagtgaaaagtcttaagacaaaccgaaagtcctggtgagatccaaggattgttggagttgaagtgctacagggagtgaactggaagggaagaaaggaggtggacagatggatgtttgaagtgagtttatggagaggcggtagttaaaagttaggttaagagattgttaacaattagcttactgttaataattaggttaagagatta

SEQ ID NO: 108397 - DNA, 493 bp, Homo sapiens
agctgggcctttttgagagaaattaatttaatgtggaaaccaacaggaagttagtattataagaaaaaattacagtaccagtagtgggctatctcctacaaagaatcttaatgttgaagtgcagccattactacctggtattctttagtgtctctgaattacttttccttatctgtagcatctaattatttacaatactctttagagctgtagactatgaatagaaaaagatgaaaagcatttaaaaactcaatcacaggacttactggggaggccaaacatttctgcttttaattcccaaactgtcccttttaatactttcccaccaggttttcctagaattgggacttctcctagaatttcttcatggtgtcttgatcctagaacttcacttctaaccctctgtactttttgtgacattgtctcttctagtttttgccatttttctatgatagacttttcagaggctattttttcaacttaaaaaattact

SEQ ID NO: 108398 - DNA, 465 bp, Homo sapiens
taggtcggacctcttgtctgctcagggagaacaaagtgccagtattacctgattgctaaattattaaattgctgcttaggctaaaaagcaatggttccttaggccctgaattaaaggcacctgacacagaccagcatgaggactgagaagcccacatagtgacctccactctgaccatacccagctttcccccacttccctgcagaccctatggagaaatctgcccagagaatcaggcaggaaaagatgagccagtgcctggcttgtcccttgagccaccaaagtgctgggattacaggcctgagccactgcgcctggtcaggaaaagactttaatgccactagattcctctcctgatgcattcaggcctgtggcatcctctagttcagtttcttgggtagttggtattacagatttagagtcttgttttgatggacatttctccatacgaagtaccgtaatgct

SEQ ID NO: 108399 - DNA, 210 bp, Homo sapiens
cctctgtccccaactgtggcacccagactctccatctcctccacctccacttcccacccaccgtcctgtctccctgggcctctgtcgtccccctctgatagctccaggccctgctctcctgtcctaccagcctcctggcccacagtccagcttctctgacctccctcttcgaagatcaacatcttgggaggacactgaggcacagagcag

SEQ ID NO: 108400 - DNA, 352 bp, Homo sapiens
tgcacagaaacaccatttctcacccacaagacagacaaaaccacatatttgacaacatatgtcactggcaagactgtgagaagagagaaactctttacatattttattgctggtaagaatgcaaaatggggctggcaccatggcccacaaggctcaggagttcaagaacagcctggtcaacatggtaaaaccctaaaaaattcaaaaattagccgggtgtggtggtgcatgcctgtagtcccagcgacttagaggctgaggtaggagattcgcttgagtccaggaggtcgaggctgcagtgaaccatgatcgtgccactgctctccagcctgggtgacggagtgagatccca

SEQ ID NO: 108401 - DNA, 205 bp, Homo sapiens
tgttaatggcgttggacaccctttctcctcgccacggagccagtgtagggaagtttcacttatgaaagtaggaaatcacttaaaagaggaggcgatcctcctcctctcctttcacttacgagagcaggagatccctctgaaaactcatgctttcattttgggcttattgctgaaatgtgaaacaagatgtttgcaagttggcttc

SEQ ID NO: 108402 - DNA, 481 bp, Homo sapiens
aaagtgactcacactccaaacagaatcctatactccatgaaattcaagaaccagcctcaactctgagctaaactacaaatctagcttttctaacactttaagcttagaaaaacaaacctttatttatcaggttggtgcaaaagtaatcgcagctcttgccattactttaaatggcaaaaccctcaattacttttgcactaccctatcatatgattcaaaataaatgctggacaaaaaccagaaccaaatcttttaacaggtaaaaatgaaagttgtcccataggtggcagggttatgaactctattccacctgctccaatgttaaaaatgttgaagtcttaaccactctctagtgattttcagaggtaattacaaaaggattcaagacaatcttaaattttatatatgacttacacatgaaaacggaggggaaggggaaaatacactaattattatttttatattccccaaatcatccatt

SEQ ID NO: 108403 - DNA, 766 bp, Homo sapiens
gcaagtggcagtggtttcttacatttgaaatctgagagagaggtttgggccaaagatacaagtttgggagtcatctgcataaagatggtattaaagagttctaaacggggtgttatcaccaggggagtaagtgtagacaaagaagagcgccaaggtctgagtcctggaatattacaacactcagaatctgtgagaagaggaaacaccagcaaataaaactgataaagagcagccaaggagataggaaagaaactaagagaaaggggaagtcctagaagccaagtgaagagaaaatatagcaaggagaagggggatcaactgtgtcaaatgccactgatactcaagtaagatgaggagtgggagctgcccattagatttagcatgtgaagatcattgatgtccatgataagacttgggtgcctggttggggcaaaagcctgagtggggtgagtttaagagaaaataggaggacaggcattggagacaagcagtacagacaactcattataggagtgctacaatgagaagcatctaaatggggtggaagctgatgggcaaagtgggattgagagaagccacttgttcatttagatggaagaaacatcagcgtgtttgtattctgatccagtacaatgaaaaggctaagagcttagacctgctaagctcacatactcaggcttccatcttctagtgatgactcctattgtgagttcattgaggatgagagctaaatgtctacccttacctcttgacataagatatatag

SEQ ID NO: 108404 - DNA, 518 bp, Homo sapiens
gcaatatttttccccaaaaatgttgacatctttaacatcaacataatgtcagttattatgtatatatatatagacacacatatatatatacacaactgttcccttttatgcttctttctctttatccatgggcttcaattgccagcgaaaatttttggaactattacatgacatttttgaagcctataacaagcatatattagtgtcagcagtaaaaagcacctaattctgttttcacagtgggaagccacatggtaaaggttatacactgatgaatatattattttgtaacaaatttatggggacagagatggagagattcttacctgaaggcaaatctagctgtttgggttaagagtccaatgcccatgatgatgcagctcatgaaaaatgtccatttcaatgagctattttgaatatttaattcaataatatttagtgagtgtctattacccaaaaggcacagttctttaagtatcatgggaagagtgactctaatttccaaaacaaaacaaaac

SEQ ID NO: 108405 - DNA, 331 bp, Homo sapiens
aaatgaggaccttggacaagatgttgaccattggccttaaaatggacactgtgcagaagctgacccaaacccactcccggccaagccacagaactagccaacttctccttggaggaaggatgtagacacaggagtctctcatcatgcaggggccatcactggcttctctgcacagcagtggggcacaggactgctgggtgacatggagccatgtggagaatcagggagacaggactgtgagcaggaggcagaagaaagcatgcaaagcaggggtcaagcagcagtttgagcagatgcagttctagggagttcacggctgtgtgaacgtgag

SEQ ID NO: 108406 - DNA, 989 bp, Homo sapiens
aaaaaggaagatagccaggaatacttgtgaacagagagcattaactcttaggtcagtcatgatttgctacacatttggagccaatcttcaatttgcacgttaaaaaaaattaaatagaggtttttgatccctccctcaattaacaacctgctcaacttcccctctgcccttcactccagccctgatttgaaaggatttcttgtgagttctaagaagccctggacagatgagggtggagttctcgtttggggtaggaatgagaaaattagaatatcaaagtaatcccagcactttgggaggccaaggcaggaggatatctttagcccaggaatttgacactactagcctgggcaacagagtgagaccttgtctctacaaaagcaaaagtagctgagcttcaggggatcccttgagcctgagagatcgagactgtagtgagctgtgatcctcttactgcactacagcctcggtgataaagtgaaaaggaaagaagcctggctctagtgaagagattctggaaacttctgaagcctctgctgtggctcccatccagcctagatatggaagagccatgaggccctacatcaccaaggtaaggagagtggagtctagggtcacacagtttctcagatccactttgggggcagcactttctttgaccctgactttctgtggacttcgaatctctcagctgagggctgtagtcagtagggaaacggatcagaggcaaagctccaagaatattaggtattcgacacttggtttagcagctgacttttgttttctattattttactcgttgtgtgtgtgtgtgtgtgtgtgtgtgtgggggacaatcatttgcttcagaagacagtatggtgtgatacaaggaatatctggagtcagacagaagtgtgtccaaatcccagctcggtctgaccctgaccggttcctcttcgtggtctcagggtccttcactctaacagtggggtagtgagacctacccg

SEQ ID NO: 108407 - DNA, 2103 bp, Homo sapiens
  misc_feature (2008)..(2008): n is a, c, g, or t
gaggcaaatggcattgtataatatgtctgtacaaaaaacaaacaaaaaaccaaacaagggcaaatagaaccctttggattggtattgtactatctgtttctgaagacccagaaacagaaaacaaacttttccccagacttactgtttccttgagaatcctttttctttgttcttcatactttaacttccataaggagctggctcctctgcctataaataagagcttagagaaatacttcaaaaagctacctgcagttagctaaatattaccaagtctgcctggtacatgtttcattatatttccttgcctcagtttgttatctagatttaatttacactccatgtgatatagctgttaaattagaaatgagattctttcttctgctttagcaaaattcagtgacaatttttagctccatttccaatttttacatatgtgcgatcacttggttcatactgataactgaactgactcagtctcatatttatcaggtcagataactgtgcttaaccgtgcatagtgggccagtcatcatttatgtgtcatcttctttatttgctttgtgaacactcaccacagcacctatttttctctggtattttttatactaattttcttgttagaatagtttccttaatgtacagaaattgaactagataattacagttgttctaaatatatttttctggacatttaaagaaatcattctaacaccagagattaatgttacctgttttagtattttatacaaattgattcctacagtgtaagctgtattgtactgtatacttcaattcatatgataaagaaatacaatgggctgtaacaatacactaaaaacaggaatgagtgaggggttaagttcacttggagtattacacctatcctttgcatctactgttttctgtgaaattttacagcagtgatgcccttccatataggttcttccatataaaatgtgatcatattttgggaaaaaatacaagaacattttaaggtaatttttgatttatagatctatatgatgataagtagatgccaagaggggtaggaattagaaatggaaagaagtaaaccataatgttaaatattttcaaaggatacttgtttttcatacaggaaaaaaattaggatttttaaacacctctccttccctcttgtttcaacttaaaaatgctatacagataaattcctcttgttttgtggaaatacagaataaatgtgaaagaaatacaaatcactttatcgtatgcctatacttcatgtagaacagctatagctgagttctcccacacagtctactttgatggcagaaatggagacacacagggtacccttatagtcacggcaacttttgtgttgtctttttacacaaagttggaagtattagcaagtgaattgctgaaatgtcattactaccaggactgctttgatgataaggttgaattggaaaagttaattttaataagccatgtacaataatacctgtttacttctaatgatctgaaaagcaggaaggtttttacggagccatgaacaaaaatctgaacatgcttttcttaaacttttggagatttgaagaagggttgcaaaatgtccaaaatacagttttcacaagaaaacacatcaaacctgattgttgccaatcattgtgatataacttctattcatttttggaaacatactcctgctttgtctatcatcacttgtatgtttccttgcagtgtggcctcaggaaacaagtgtatttttctgtcagacagaacacaagttgcatagataaatattaaaactagtactcatgaaagcataacccattagtgaacttaggtacagacacaaatacttaagtcagcaggaagtttactctttccttaggttactactccatgagagtaagattgaccatatcataatgtttggagccctttctgatgcattttctacagtgggtaaaatgatgtaggtaaaaatatattggctgggcgtggtggctcacacctatantcccagcactttgggaggccgaggtgggcagatcacgaggtcaggagttcgagaccatggccaacatggtgaaatcccgtctctactaaaaatac

SEQ ID NO: 108408 - DNA, 760 bp, Homo sapiens
caagaaagaaaacattgttgcgctcctctcagtccctgagaccctaacttgtgatgtttaccgtttaaatccacgggttaggctcttgggagctgcgagtcgtgcttttgcatcctggaaatttggtggaattttattctttaaagcaaaaacaaaagaaaagaaagtttgtctgaggtgattgagtatacctctgaggttttcattgttagatgggatcaggtgaccagagagtggcagctcctggatttctgttaaagtaggtatatattttgctttaatagcgtgttggctgctatgtatatgtatgcatgttattgatgcctgaggcttgtggaactcatctgcctggtctattccttgagagcaacacgcagtagtatacgagcgtaacaagaacagctcagtacctggtgcttgacctcagaacatctcagctgaagtcccagcatgccccatgtctccaactttcaaactccacagttaatcttaaaattgtgcccaattaaaatgggcatgtgaatatattatatattcagtgtccacacatgtgtatcatggatggctagacagtgaacatacagacgcagataaaggcaaactaatagtttggagtaaaatattaataggttaaaattctattcttgcaattccacacaaaggatggaagttatggtattaataaaaattaagtttgtatgactttgcaagattttttaaaaataaaaggagggataccacctccttgcttggtatcttt

SEQ ID NO: 108409 - DNA, 416 bp, Homo sapiens
tcgcgaacgtatatcctagggttcgtgtcccttggtctagctgtcaagtaaccacggaccctagaataacacgtttttcactccgtgcccccttggatcgaatgcagggactgttattttgctaaattgtgctttcacgttctgaagcacacttgcatgttgttatgcagtggtgtttaaatcctaaccaaagtgtttttgttgcaatggaaatatttcaattaatgtttagggttggaacatataaacaaagcttgggtccagattagttgattaatcattgcattccggggtgcaggaagagttttgttgaactctatcaggggaggaattaatatcctctgcctgtgaggtctttcctggagaaagcttgggttttaatgtttctccttacaggatatttttcttttggcaag

SEQ ID NO: 108410 - DNA, 1581 bp, Homo sapiens
ctaagaaacaaaagaatttcaagataattaggtggagcgggcgggctggctgctgaggacgcgccgcctgcgccttcctccctgcgtgcctcgccccgggcggcccggggctgccgcggtgcgcgggtgccgggccctgccttgccggccatgggggaagggggcgccgcggcggcgctggtggcggcggcagcagcagcagcagcggcagcggcagcggtggtggccgggcagcggcggcggcggctagggcgcagggcgcgctgccatgggcctggccgggctgcaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgcctttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaacgtgggaactgccaaaccaaactgcacgacatcgacggcgtacctcacctcatcctcatcgcctcccgagacatcgcggctggggaggagcccctgtatgactatggggaccgcagcaaggcttccattgaagcccacccatggctgaagcattaaccggtgggccccgcgccctccccgccccactttcccttcttcaaaggacaaagtgccctcaaagggaattgaatttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtacttt

SEQ ID NO: 108411 - DNA, 1229 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (15)..(15): n is a, c, g, or t
tgtncngnantatcncggctatggtagcgaggctgggtggccgggagatcccaggcggtgacagagtggagccatggctagaggcaggaagatgtccaagccccgcgcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgcctttgtggtggaataccacggggacctcatcgagatcaccgacgccaagaaacgggaggctctgtacgcacaggacccttccacgggctgctacatgtactattttcagtatctgagcaaaacctactggtgagtccactgttgcttagagtggcttttctgtcctctgggcagtgaggagaggccaaagggccaggaactcctgattctgtttggtggccagtcttttggttttgttgttgttgacttttttttttttattttttgagatggagtcttgctctgttgcccaggctggagtgcagtggtgtgatctcggctcattgcaacctcctctcaggctcaaagaattctcctccctcagcctccagagtagcccagctaattttttttttctgtatttttagtagaggtggagttttgccacattggccaagctggtcttgaactcctgacctcagacc

SEQ ID NO: 108412 - DNA, 822 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (15)..(15): n is a, c, g, or t
tgtncngnantatcncggctatggtagcgaggctgggtggccgggagatcccaggcggtgacagagtggagccatggctagaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaaggtaagcttttgaaatggcctcgttctgatcccagctggtcgggttgcagaagcctctgtcttctgcaagaatgcacatatgtatttatccaaccttttcagtctcagattcgagaggtttgagccatgttctgtcttgctgctgaaagaatggcttgtcccagggtgtgtgccctgttggtttgacaggttcttcctgctttcacaagagttagcatatccttcaagcttgattgtcttgcttagttgcaaagtcatgaattcaggttgtacagaccaggcaattgcagacctaactaatgtgttcatgtaggggactgacttttcttccttttatgagctggtcttgaccccatttcttttctttttttgagacggattttcgcttttgttcttcaggttgaatgcaatggaaccatctaagttaatgaaacctcggcttctgggttaaggaatttttt

SEQ ID NO: 108413 - DNA, 1256 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (15)..(15): n is a, c, g, or t
tgtncngnantatcncggctatggtagcgaggctgggtggccgggagatcccaggcggtgacagagtggagccatggctagaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgcctttgtggtggaataccacggggacctcatcgagatcaccgacgccaagaaacgggaggctctgtacgcacaggacccttccacgggctgctacatgtactattttcagtatctgagcaaaacctactggtgagtccactgttgcttagagtggcttttctgtcctctgggcagtgaggagaggccaaagggccaggaactcctgattctgtttggtggccagtcttttggttttgttgttgttgacttttttttttttattttttgagatggagtcttgctctgttgcccaggctggagtgcagtggtgtgatctcggctcattgcaacctcctctcaggctcaaagaattctcctccctcagcctccagagtagcccagctaattttttttttctgtatttttagtagaggtggagttttgccacattggccaagctggtcttgaactcctgacctcagacc

SEQ ID NO: 108414 - DNA, 958 bp, Homo sapiens
agcggccgctcgcgatctagaactagggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgcctttgtggtggaataccacggggacctcatcgagatcaccgacgccaagaaacgggaggctctgtacgcacaggacccttccacgggctgctacatgtactattttcagtatctgagcaaaacctactggtgagtccactgttgcttagagtggcttttctgtcctctgggcagtgaggagaggccaaagggccaggaactcctgattctgtttggtggccagtcttttggttttgttgttgttgacttttttttttttattttttgagatggagtcttgctctgttgcccaggctggagtgcagtggtgtgatctcggctcattgcaacctcctctcaggctcaaagaattctcctccctcagcctccagagtagcccagctaattttttttttctgtatttttagtagaggtggagttttgccacattggccaagctggtcttgaactcctgacctcagacc

SEQ ID NO: 108415 - DNA, 945 bp, Homo sapiens
agacgggatttcaccgtgttggctggactggtctcaaactcctgacctcagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgcctttgtggtggaataccacggggacctcatcgagatcaccgacgccaagaaacgggaggctctgtacgcacaggacccttccacgggctgctacatgtactattttcagtatctgagcaaaacctactggtgagtccactgttgcttagagtggcttttctgtcctctgggcagtgaggagaggccaaagggccaggaactcctgattctgtttggtggccagtcttttggttttgttgttgttgacttttttttttttattttttgagatggagtcttgctctgttgcccaggctggagtgcagtggtgtgatctcggctcattgcaacctcctctcaggctcaaagaattctcctccctcagcctccagagtagcccagctaattttttttttctgtatttttagtagaggtggagttttgccacattggccaagctggtcttgaactcctgacctcagacc

SEQ ID NO: 108416 - DNA, 4047 bp, Homo sapiens
gcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgcaggagtttgcgaa

SEQ ID NO: 108417 - DNA, 275 bp, Homo sapiens
cgcgtccgcgaagggcctcagctaggaaaacacgggctggtctgccaggaagcctggagctcagagcgtctggtgggccagaggctcggagctgggaggccctgagggtctctgcttctccgcctcagcgacgaatgctgacacaggagaggcccaggacacacacggctcccagccgagtccaagacgtgcctcgcgagttcctgccgaggaccctcaccggctacgtgcctgaggacatctggaggaaggctggtgagtgggggtgcaggggc

SEQ ID NO: 108418 - DNA, 4122 bp, Homo sapiens
gcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgcaggagtttgcgaa

SEQ ID NO: 108419 - DNA, 4150 bp, Homo sapiens
  misc_feature (27)..(27): n is a, c, g, or t
gagggcagaggacacccagttggtggncgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgcaggagtttgcgaa

SEQ ID NO: 108420 - DNA, 3470 bp, Homo sapiens
  misc_feature (27)..(27): n is a, c, g, or t
gagggcagaggacacccagttggtggncgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcacccccaacatccccacctctgataccacaatcaaaagggatac

SEQ ID NO: 108421 - DNA, 247 bp, Homo sapiens
gacgccctgacggtcatcaaccagcaggaggactccagcgaggtagggccacccggccacgctgacacccatcccctgcctcggctcccgtgcggtcccacgccacccccatgaggattctgagcctccacgtggcatcagcacagttgtcacgggcatcctgcagcaggcacgccatccccgcccacactgtgctttatcagcacagagatcccacatggttcagtgaggcgtcctatggatgtcc

SEQ ID NO: 108422 - DNA, 462 bp, Homo sapiens
gcggccgccccgcgcgccccagccccgccgcgcgcctgagcccggtgcggcgccagaagacagcgcgcagccgcccctgagtcgtggaggcggggaccaagctggaaggagcagcgactcccggaccgagtcgcgagtgtgcgccgtccgccgcccgccggatcccccggaccccccgaccgtaagtgccgtgtccgccccgcgcgccgccgccgctctaccccgactccgcccgcggctgccgttcccggatctgcgccgcagccgcgccgagcgcacgggccgttttcaaagttggtgcccacggcagggtggagccaacccgcccagcgcccacccatccgggctgagcgcagccccccgtgagcagagcctgacctgcgggggctgcggcgaaacttcgaggggaacgacgcgcccgggcgctgggagtctcgcgggctcccctggggccgcccggtt

SEQ ID NO: 108423 - DNA, 4279 bp, Homo sapiens
  misc_feature (27)..(27): n is a, c, g, or t
gagggcagaggacacccagttggtggncgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgcaggagtttgcgaa

SEQ ID NO: 108424 - DNA, 3955 bp, Homo sapiens
  misc_feature (27)..(27): n is a, c, g, or t
gagggcagaggacacccagttggtggncgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacacatcgagaggacgggcctgcgacgctgccccacggccgttttcatggctgcttaaaatggtctatggtctgtctcttgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagctggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgcaggagtttgcgaa

SEQ ID NO: 108425 - DNA, 4051 bp, Homo sapiens
gcgggatcctgtgtccagctcttccactcgcccgtgttttctgggtccatccccactggagcgtgtgtcggacctgccttccttcttatgtctgaataagtgtgcactgcatctgcttttgagtttatctgtgctcggctgacagtctatggagaaccttgtctcaccacagctgtgtgtctcagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcctccagccctgcccaccctccctccactcctctcaactgcctcagcgatttcaagaaggaaataaagggataaagaaattcatgcttgcaccgagtacaaggacagacagcaggcacggcccgcagcctggcatctgtgcgtgtggcgtggcccgtggcttggcatctgtgtgcgtggtgtggcccgtggcctggcatctgtgtgcgtggcgtggcccgtggcctggcatctgtgtgtgtggcgtggcccgtggcctggcatctgtgcgcgtggcgtggcccgtggcctggcatctgtgtgcgtggctatcaggagttctaggaactcagtgcaatacgggagtgacccagctactgaaccagccacgaacagcccgccagaggcctgaagctgagcgtgtacgttaatgtgaatgtatatagtctttgcagaggtccaaatgatattcatgatggtaataaacgagatgtttgccaaataaaaaacagaaaccgcaggagtttgcgaa

SEQ ID NO: 108426 - DNA, 3749 bp, Homo sapiens
  misc_feature (27)..(27): n is a, c, g, or t
gagggcagaggacacccagttggtggncgggagggcctcggctttccagggacagaggcccaactccaggacgccccagctggcccagcccctcctctttccctcaaggctgcaggaggtcgggaaaggcagtcctggtagaggcctgtcctgggctccaggttggcccctgagggtggccctcctcatgccggcttcaagactgagggacagggcagccagttcagcctcgggatccacctgtggctccatgtcccagacgcaccctgtgctggagagcggcctcctggcatctgccggctgctccgcaccccggggtcccaggaagggcggcccagccccagtggacaggaaagctaaggcctcagcgatgccggactccccagcggaggtgaagacgcagccccggtccacaccccccagcatgccgcccccaccgcctgccgcatcccagggggccacacgccccccctccttcacgccacacacactgatgaacggcagcagccactcaccaacagccatcaatggtgcaccgtgcacacccaacggcttcagcaatggcccggccacctcgtccacagcctccttgtccacacagcacctgcccccagcctgcggggcccggcagctcagcaagctcaagcgcttcctcaccacactgcagcagtttggcagcgacatctccccagagattggggagcgcgtgcgcacactggtgctgggcctggtgaactcgacattgacgatcgaggagtttcattccaagcttcaggaggccaccaacttccctctgcggccgtttgtcattcccttcctgaaggcaaacctgcccttgctgcagcgggagctcctgcactgtgcacgcctggccaagcagacgcccgcccagtacttggcccagcatgagcagctcctgctggacgccagcgcctcctcccccatcgactcctcagagctgctactggaagtcaacgagaacggcaagaggaggacgcccgacaggaccaaagagaacgggtcagaccgcgacccgctgcaccccgagcacctcagcaaacggccatgcaccctgaaccctgcccagcgctacagccccagcaacgggccaccgcagcccacaccgccgccgcactaccgcctggaggacatagccatggcccaccacttccgagatgcctaccgccacccagacccccgggagctacgagagcgccatcggccgcttgtggtgcctgggtcccggcaggaagaagtgatcgaccacaagctcacagagcgtgagtgggcagaagagtggaagcacctcaacaacctcctgaactgcatcatggacatggtggagaagacgcggcgctcgctcacggtgctgcgcaggtgccaggaggccgaccgcgaggagctcaaccactgggcgcggcgctacagcgacgccgaggacacaaagaagggccccgctcccgccgcggcccggccccgcagcagctccgccggtcccgaagggcctcagctagacgtgcctcgcgagttcctgccgaggaccctcaccggctacgtgcctgaggacatctggaggaaggctgaagaggccgtgaatgaggtgaagcggcaggccatgtcggagctgcagaaagccgtgtcggacgcggagcgcaaagcgcacgagctcatcaccacggagcgtgccaagatggagcgggccctggccgaggcgaagcggcaggcctccgaggacgccctgacggtcatcaaccagcaggaggactccagcgagagctgctggaactgcgggcggaaagccagtgagacgtgcagcggctgcaacgcggcacgctactgcgggtccttctgccagcatcgggactgggagaagcatcaccacgtgtgtggccagagcctgcagggccccacagccgtggtggccgacccggtgcctggaccgcccgaagccgcccacagcctgggcccctccctgcctgtgggtgctgccagccccagcgaagccggctctgcggggccttctcgccccggctcccccagcccacctggcccactggacaccgtgccccgctgaccccactggcccctggcctgccggacacagcaccgtgccaaccccacccagctccaggcccaccggatgctgtgcctggcctccgatgcctggcctgccagacactgcgccccgcctgacctgggggagccgaccaattagtcactgctgctactgcccctctccgaaagaagacacagaaccaacaaaaccgcattcagtgcacctgcctcagctacctaatgattccgcgcggagacctcctgacaacgtctcttcaagcatcctcagaagcctcgactgagctttagacagcagagcagatgccgcaggcgcggcggctctgcccacctctcttttcctctctgtctgtctctccccctctgtcttctctatcctctctctctctatgactatcacacactttctcttcaatgaaaaaatcgaattggtggcttatattttcagcaaagaattttggggggttttgtgtgttggcaaaagagctactcagaaatggacaaagaaaacgggggggttctccccctcctgattaaaaagggagaaagaaaactgcgattttatagctggagatctgaacccagctgtgcccctcccccaggggcgtgaggctgatcagcgaagacgggaggaaagatttcgatttctgactcaagatgcatttttggtttcagatttttttttcctgtaatgttaaactctttggctttaagtaaaaatccaaaaagtttttttaaaaaagcaaaggaagcatacttgtgaactaccttgctagctagccagccaaggataccggacacacctctgctccaaaggaaatccaaaaaagcaaacacaagaaatcaaaatccaaaatttgtttgtcactgccaaagtatttttttcactgtttcacttgctcttgggtttgtttggatgtgggtctttttctcttctgttctgattttgtttgtgggtgtcgggatatttgggtgcagagggtttgtgcccagttagaagcgacttttgttctcttctgcgtaggcgttggtgcgtccgccgcgtgtgcgtggtccgtgtgccgttgctccggcctgcgtctccatatgtgtaggaaaggacacgccgtctgtcctcacgccccctgtgacttttcatatttccgttttccacttgtggaaaaaaagtgctaaagttttcttcccagagagagcataattccgaaacaaaactgtgacaatcttttgggttgattctcgactgcttttcgagcatgcggagccagcaggcctccctgaaacactgcttctcggccagcccgtcctcctctacctctctcctctccgcgccctccgacctctctcggccccctcaccccagctccgacctctctcagccccatcgccccaactccaacctctcggccccatcgccccaccgcagctactcccctttcttccaaacttttgcagaaaaaacaaaaaaactacaaacaaaagcagccctctgcctcctccccagggaagaccctgaccgtgtacatagccctggtgctcctgcccagccacccctcagatgcgttcgcctctggccctggggtgtgtctcggtgacgttttctatcagacgtgctccctcccatcttcggccttggcacctttcttcaattttttaattggctcaggattcaagaagga

SEQ ID NO: 108427 - DNA, 357 bp, Homo sapiens
tgggaaagggaatcaaaacaaaggcagagaaggtaaaaataactttcatatgtggggctgcttcctatgtcgttgaattagaaaaaataaaatggcaatgtatttagcatagtagtgaaaactccagcaggtggtatagcaacaagggaaacctgagcttcattgactccttgcatctcacctacttctaaaaaagactcaagtcatctacatgtagacagcacagtgtgtagaactactcattcatcctgtaaacatatattgattgccaataatgatcccacggtagaggctgggataccaagatgggtgacccatgaccttccctcaaggaaaacagacaaaaacagctgtaat

SEQ ID NO: 108428 - DNA, 428 bp, Homo sapiens
gtgggccgcagagcactacgggacagagtgaggcacgctcagggaagtggggatgatgtggctgcagatacagcagatgtgggcgcagccccagttggcagatatggagggcacacagtccccttcccctggaggaaggcacgaaaagggacctcagatccctggtctcctctcagccaggctcctcaaaggggccatcaccattccaacccaatttcaacagaataaaaatgaggggagtggagcacttgggatatgtctaggctgcaccccaacacttaccatatgtctccctgatattccacctctgctcctccatctgctgaaggaggagcggaactcaccttccagcctccccagcacagggaacccaagctgtaccagtccacactccacgtgcccaggcaggctgcacgctatgcctccat

SEQ ID NO: 108429 - DNA, 399 bp, Homo sapiens
gagcatgtaacctagatccctcacatgtgcagttcacaatagggttcgtgctcctgtgagaatctaatgccgctgctgatctgacaggaggccgaactcaggaggtaatgctcattcgccctgttaggccaggttcttaataggccacagactagtactggtccatggccctgggtttgaggacccctgcctaagagggccaaaacaaaggtaagctatttctaggtcaatgataagtttcctcaaagtaaactgaaacttattgctgttatttcttattgtttccttatattaaaagcttactgtagaaaattctaatgcttataacatctaatcttccatctcataaatttgaaagcttcttccccacacagctgtgtatctgtccctctggtcttc

SEQ ID NO: 108430 - DNA, 270 bp, Homo sapiens
taagtaaactctctgcatttgccacggttctcatgtgaaacagaaccaagaggatgtatgtgtgtgtgtgtgtgtttgtgtgtataaataataaagaaatttattataagaaattggcccacacaattatggaggctggcaagtcccaagatctgcagggtgagtcagcaagctggaaatcaggagagccagtggggtagtttcaattcaaaagttggcagactcaaacccagtaagagccaatgtttcagttttagtctgaagacagaa

SEQ ID NO: 108431 - DNA, 298 bp, Homo sapiens
agtgccccattttttttttcttccaagtaactaagttctgtgacttggatgctgtgacttggactttagaggtgaagtcagatgacaaaagatttccatgcaaatcatgtttccagaatcatccctcatgtgcatgtatgtctagtggaatgcaaggcttactagagggaggttgaaatttggtgtgcgttaaaggaaatataaaaatcctgcttaatgatcctgttaggtttgtatacagattaactgttattacacaagaaatggtatgtccgtttggaatttctcatcctctgaa

SEQ ID NO: 108432 - DNA, 187 bp, Homo sapiens
ttgaagttgttcattcatttgtgtaacaattatttattgagcacatgccacactccaggcctgtgctaagttcagcagcacaacactgcacatggtttctgtcctcaaaaagttcaaggaaacagatgatccaccaagcaattcacaaaccataatctggagcctgaggttcccatctaaccatgcc

SEQ ID NO: 108433 - DNA, 318 bp, Homo sapiens
gactggaaattctagagttgaaaaacacagtaagtaaaatgaaaaattcaaaagaggaactcaacagtagatttgagttggaaaaagaatcagtgaatttgaagataaattgagattatgcaatttgaagcacagagatgaaaagaatgaggaaaaataaatggcatcagagaaatgtgggacaccattaagtgtaccaacatatgtataatgagagtcccagaaagatgagagaaagagaaaggagataaaaacctatacaaaggaaaaatggctgaaaatatcacaaatttgaccaaaaaaaaaaaaaacccaaac

SEQ ID NO: 108434 - DNA, 1474 bp, Homo sapiens
agttgatgctagctccccgccgggctcgcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtat

SEQ ID NO: 108435 - DNA, 367 bp, Homo sapiens
tgggattacaggtgtgagccaccgcacccggcctaaccttgacagttttaaagttgtgtgctgtggattcgttccccatttaatatgtggcgtaaagtaggtctttctctctctgcagaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactcta

SEQ ID NO: 108436 - DNA, 1461 bp, Homo sapiens
ttatttcagtccacgggcctcgggtttaagttttacgattactatgcccgttgccttgccatttcccacgcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtat

SEQ ID NO: 108437 - DNA, 1620 bp, Homo sapiens
agttgatgctagctccccgccgggctcgcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtatcaaaatggttgtgtctcttttatgttcactatactatgaggcttagtatttagataactggctgaatgcgagaaatgtagggggaaaaacttggttaacggattagaattgcgtgaaggggaaagtgtgggggggggtcgcgatca

SEQ ID NO: 108438 - DNA, 1281 bp, Homo sapiens
gtaaaataaaatgtttcttgtccaagaaacgagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtat

SEQ ID NO: 108439 - DNA, 1249 bp, Homo sapiens
agttgatgctagctccccgccgggctcgcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactcta

SEQ ID NO: 108440 - DNA, 1407 bp, Homo sapiens
agttgatgctagctccccgccgggctcgcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaagtcgatcttggagaaagagggaccaaagtcactttttagaggcttgggtccaaatttggttggagttgcaccatcaagggctgtatactttgcatgttactccaaagccaaagagcaatttaatggcattttcgtgcctaacagcaatattgtgcatattttctcagctggctctgcagagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtat

SEQ ID NO: 108441 - DNA, 1396 bp, Homo sapiens
agttgatgctagctccccgccgggctcgcgccgcagaggccggtgaggcgccggcggccacgccgcggaaggcgcgggccgagcagagccgggcgttggagcccgcgcgcgcatggaggcgttgccggcagccccctgagggcagcggggagacaagacccggcgacctcgcgcatccctcgagccgccacgcgctctcgccaccgggcggcgacgggccgcggagccggcgcggccatggcgacgggcggccagcagaaggagaacacgctgcttcacctcttcgccggcgggtgtggaggcacagttggtgctattttcacttgtccactagaagtcattaagacacggttgcagtcttcaagattagctctccggacagtctactatcctcaggttcatctggggaccattagtggagctggaatggtgagaccaacatccgtgacacctggactctttcaggttctgaaggctgtatactttgcatgttactccaaagccaaagagcaatttaatggcattttcgtgcctaacagcaatattgtgcatattttctcagctggctctgcagcttttatcacaaattccttaatgaatcctatatggatggttaaaacccgaatgcagctagaacagaaagtgaggggctctaagcagatgaatacactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtat

SEQ ID NO: 108442 - DNA, 756 bp, Homo sapiens
tcgagctggccaccgtacattcgtgtccactccagtgtgctcgttacgtttaccagaccgaaggcattcgtggcttctatagaggattaactgcctcgtatgctggaatttccgaaactataatctgctttgctatttatgaaagtttaaagaagtatctgaaagaagctccattagcctcttctgcaaatgggactgagaaaaattccacaagtttttttggacttatggcagctgctgctctttctaagggctgtgcctcctgcattgcttatccacacgaagtcataaggacgaggctccgggaagagggcaccaagtacaagtcttttgtccagacggcgcgcctggtgttccgggaagaaggctaccttgccttttatagaggactgtttgcccagcttatccggcagatcccaaatactgccattgtgttgtctacttatgagttaattgtgtacctgttagaagaccgtactcagtaacaggccggaaaattgtgctctagaagaataaaactgaaaaactctagagaattttttttccccattgatgtttagaaagtttgagactgaaacaggaaaggccataaaatatctggttcatatcacctgttggacatttccttttggattcatgctttctggaaggtttaaattcattaacgttaatagttaattataactttttttttaacttaagaggattcagggttaagcaccaactaaattaaatcatgctatttaatttaagtat

SEQ ID NO: 108443 - DNA, 387 bp, Homo sapiens
cttatgagttaattgtgtacctgttagaagaccgtactcagtaacaggccggaaaattgtgctctagaagaataaaactgaaaaactctaaaaaaaaaaaaaaaaaaaaaagttgttgcttagggcttagggatatagtactgggaatatttcagtgaggaggttggaaaccagaaagtattgtctgctatgacaagagtgttgggtatgtgaaagtgtgcctgtactacatatgctcactttgaacttacttaactgttattaccttgaataatgagttttactttatagcacttaaagacacctttctccatcagatacaggttcttggtctttgactgaagatataaaaatcatataaatgattaaagatataaaaagagataa

SEQ ID NO: 108444 - DNA, 2199 bp, Homo sapiens
aaaggagggacccgcgcgctgctggaggcgatccgcgtgcacccggacgtgcgggcggtgggcgtagagccgcacttcttcgacaggaactacgaaaaggggttggagtggtacagaaatgtgatgcccaagactttggatgggcaaataaccatggagaagactccaagttactttgtgacaaatgaggctcccaagcgcattcactccatggccaaggacatcaaactgattgtggtggtgagaaaccccgtgaccagggccatctctgactacacgcagacactgtcaaagaaacccgagatccccacctttgaggtgctggccttcaaaaaccggaccctcgggctgatcgatgcttcctggagtgccattcgaatagggatctatgcgctgcatctggaaaactggctccagtatttccccctctcccagatcctctttgtcagtggtgagcgactcattgtggaccccgccggggaaatggccaaagtacaggattttctaggcctcaaacgtgttgtgactgagaagcatttctatttcaacaaaaccaaggggttcccttgcctaaagaagccagaagacagcagtgccccgaggtgcttaggcaagagcaaaggtcggactcatcctcgcattgacccagatgtcatccacagactgaggaaattctacaaacccttcaacttgatgttttaccaaatgactggtcaagattttcagtgggaacaggaagagggtgataaatgaggctagagaggcagaggaaggctagtcaataagctaaggaggctccttgcctgagtccttgaataccccagcttctgcagcttcacttgctggagtgccaagtagatctcctcctccttcatgcagccaggattgcctccagtgctgttagcttaggcaaacaggtggatcccatggcatccccatggaggaaccaggcccatctgggcagcagcatctggttgaccagatggccaccagaacccactgttcattcttatcttctgctagttaatatagcctgaagacagaggataaatagttgtcaatgtcagagacagtgctattaatgtatatgtgagcgacaaaaaaggtctgctttataggggttctcactctagcttggggagccagggttctagccctgtatctgtcatgggcacctgctgtctaaacctctgcttgggcttctccccagaatgcactttgtggctgagtgctccaggactcctagggagcaaggtcctccctctaaggtgtttctagtcttctctttaaaggtctcatcccacaacccctgacttcctccctccccacatcatgaaggcagaggcatgcacattcctcactgaaaaagaaaacacacacccacccacacacacacacacagaagaaaatgaaagctgacacacctcgaagccttctttccaagagccctctaaatggggttgggtctcactcttcatgagtatcctgggttgtgcagaagcttagcatatgcccttgtgttcggatcaggcccacagggctgctcaaagagtagagtaattgtaaccgaggtcagagctctggggttggcagagatgagtggccatatctgggggtaaaagaagaaatcctgtcctcttggtgggaggttaccttacctgaagaccatctctcccaagcactgtagttctgagcatgtttttggggtggactctgtcccctagggtccctagaagggcaaagaccagagagttgacaagtctgttattaggaataatccttagccatgtaatggagaaaggagcagtcagcattcttccaatttgccccaccaccacctcctcgggcttcattttctctatttagagatggcagagagtgaggtagtggcgagaaagctgactccattcatcagatccagtttatgagggttgggggtgagcaagggctgtctgcagaaacccccatcaagagctgctgaatgaagtgtcccttcccatcagtttgattcaattaaaatgcatcatttgacataaagcacttgttcacagatctccaaaaccaggaattgttctagtaaaactggaaatttgtatgagtggggggagttaaatctgttcagctgttattaaactgtcatttctcccgctaaatgaaaaccgtgttgttataaagcttaatgcaacctgaaaaaaaaaa

SEQ ID NO: 108445 - DNA, 2259 bp, Homo sapiens
gctggatctgcattaaatgtcgaaaggaaggcggagaggggtgagacaagaggtgggaggtgaggcaggtgggagcctgaccctggagaaccccgcaggtggtgcttctgactttcagtttcagctttgacaccagcatggagctgactgtttgtcctttgctctggtatttagagaaatgtgatgcccaagactttggatgggcaaataaccatggagaagactccaagttactttgtgacaaatgaggctcccaagcgcattcactccatggccaaggacatcaaactgattgtggtggtgagaaaccccgtgaccagggccatctctgactacacgcagacactgtcaaagaaacccgagatccccacctttgaggtgctggccttcaaaaaccggaccctcgggctgatcgatgcttcctggagtgccattcgaatagggatctatgcgctgcatctggaaaactggctccagtatttccccctctcccagatcctctttgtcagtggtgagcgactcattgtggaccccgccggggaaatggccaaagtacaggattttctaggcctcaaacgtgttgtgactgagaagcatttctatttcaacaaaaccaaggggttcccttgcctaaagaagccagaagacagcagtgccccgaggtgcttaggcaagagcaaaggtcggactcatcctcgcattgacccagatgtcatccacagactgaggaaattctacaaacccttcaacttgatgttttaccaaatgactggtcaagattttcagtgggaacaggaagagggtgataaatgaggctagagaggcagaggaaggctagtcaataagctaaggaggctccttgcctgagtccttgaataccccagcttctgcagcttcacttgctggagtgccaagtagatctcctcctccttcatgcagccaggattgcctccagtgctgttagcttaggcaaacaggtggatcccatggcatccccatggaggaaccaggcccatctgggcagcagcatctggttgaccagatggccaccagaacccactgttcattcttatcttctgctagttaatatagcctgaagacagaggataaatagttgtcaatgtcagagacagtgctattaatgtatatgtgagcgacaaaaaaggtctgctttataggggttctcactctagcttggggagccagggttctagccctgtatctgtcatgggcacctgctgtctaaacctctgcttgggcttctccccagaatgcactttgtggctgagtgctccaggactcctagggagcaaggtcctccctctaaggtgtttctagtcttctctttaaaggtctcatcccacaacccctgacttcctccctccccacatcatgaaggcagaggcatgcacattcctcactgaaaaagaaaacacacacccacccacacacacacacacagaagaaaatgaaagctgacacacctcgaagccttctttccaagagccctctaaatggggttgggtctcactcttcatgagtatcctgggttgtgcagaagcttagcatatgcccttgtgttcggatcaggcccacagggctgctcaaagagtagagtaattgtaaccgaggtcagagctctggggttggcagagatgagtggccatatctgggggtaaaagaagaaatcctgtcctcttggtgggaggttaccttacctgaagaccatctctcccaagcactgtagttctgagcatgtttttggggtggactctgtcccctagggtccctagaagggcaaagaccagagagttgacaagtctgttattaggaataatccttagccatgtaatggagaaaggagcagtcagcattcttccaatttgccccaccaccacctcctcgggcttcattttctctatttagagatggcagagagtgaggtagtggcgagaaagctgactccattcatcagatccagtttatgagggttgggggtgagcaagggctgtctgcagaaacccccatcaagagctgctgaatgaagtgtcccttcccatcagtttgattcaattaaaatgcatcatttgacataaagcacttgttcacagatctccaaaaccaggaattgttctagtaaaactggaaatttgtatgagtggggggagttaaatctgttcagctgttattaaactgtcatttctcccgctaaatgaaaaccgtgttgttataaagcttaatgcaacctgaaaaaaaaaa

SEQ ID NO: 108446 - DNA, 843 bp, Homo sapiens
tgagacagggtctcactctgtcgcccaggctggagtgcagtggtatgatctcagctcactgcaaactccgcctccagagttcaagctattctcctgcctcagcctcccaagcagctgggatcaccggcatcggccaccatgcccagccaatttttgttatttttaatagagacagggttttaccatcttggccagactggtctcaaactcctgacctcaagtgatccacccgcctcggcctcccaaaatggtgggattacaggcgtgagcctccatgcctggtccaaaatgcttcttaaactattaccatcatcgttattccactcttccattcctctctgctttaaaatgtctattaacaacttacagagaaaaactctagaagactggttttagctccataccctgtcactgcctatgtatgccttctctaccaggcaccatttcacttttcactatctgactcactcaaaggctacctcctttggaaaaatcttccccagcattgtcattctcatctggaatcctatctaacttttaacagagtactacatgaactcacgtgtcaatcctttccattagtctgcaagatcaacaagatgaatggggtttcattcatctttgtattctccaaggcctagcataagctttggaaccaaattaatctcggttcaaatctcagttatgttaaaaaacagtagttgatcctatttaaatatggtttttatggctttctgactaaagcaaaagaaaaaagaaaactggttttctgacttaaaaaaaaagaaatatcatttttacatttagatgtggatgtctaatatttttacattttacatgtaa

SEQ ID NO: 108447 - DNA, 365 bp, Homo sapiens
aggttgatcaataatggtcttattggccttttttaaaggctgctatttgatttcccaggcaggcttcccttctgaaaatgacagccacctggccacagggctgtgggagtgagctgcgtcctgaccatagtgagtgggtggggacgctgacagacacgtttcctttttgtgagttttcacaagtacgcacaagtaaggacaggcaagctgctggaactcttttggttgatgaagaagaaagaaaggaattgcttaagagcttgctttgagagatcttactgctgaactaagctactcttctgttttgctttttctcagatgctaagtaaaagacagtaaagaagaaaataattatatgttttgtg

SEQ ID NO: 108448 - DNA, 637 bp, Homo sapiens
catcagagccctttgcagtctgctcccaaattgcatgtctagccttctccctcaccatagccctgtgatactctgcccttgtgcagtatcacattccctgcagtcattgaggaggctgtgcttttgggcacctctttagttctaccaatactgttcctggaatctcctttctcttaccagctgtcctcacttgtatccattgaaatcctattattctctcattttctaatgctcagttcaagtgctattccttttcattgaattgagttgaactaaagaattatggaccaggcgcggtggctcacgcctgtaatcccagcactttgggaggccgaggccggtggatcacgaggtcaggagatcgagaccatcctggctaacatggtgaaaccccgtctccactaaaaatacaaaaaattagctgggcgtggtggtgggcgcctgtagtcccagctaaaaatacaaaaattatctggacatggtggcacttgcctatagtcccagctactcgggagactgaggcaggagaatggcatgaacccgagaggcggagcttgcagtgaactgagattgcaccaatgcactccagcctgggggacaaagcgagactccgtctcaaaaaaaaaaaaaaaaaaaa

SEQ ID NO: 108449 - DNA, 711 bp, Homo sapiens
aatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggca

SEQ ID NO: 108450 - DNA, 504 bp, Homo sapiens
aaagataggatgaatagaacccaaaagcaagatgatagacttagcaccaaccatatcaataattacattagacataaatcgaccagatactccagttgaaagacagagatcatactggatttaaaaaaaaccaagacccaaccatgctgtttcaagagatgcattttatgatattttattactttaaaaatttttaaataattttaaaattgtagaaaagttgtgagaataagaatagtacaaagagccatatacctctttatttggattcagctgttcttaacgttttaccacttttttcctgttttctctctgtatatatggacacacacatgcatttttctttgaaaaatgggcagcaagttatctactctgctgtctatattcttgttttgttaactgacccagtaatgttctatatagcagtatttttgcccctccagtagagaaaccagtttagaatcaggtgtttcatttagttgtctttaaacttgaacatttata

SEQ ID NO: 108451 - DNA, 373 bp, Homo sapiens
ccctcttgtacatctcagatgggggggcagaaaagattaagcttcctgaactaacgttctgatcctgtcttttacacacctcccctggatctctagaatgaaattcaaattccttaggctgacagtcaaagccgatcacaataccgcccttccctcgctatcaacaatatttgccggtgcccttcccttccatcccctcatctatacctccctctccacaattcccttccagagtgtaaatgaggatccactactcccatgtgcatcagcgtgtctgtccccacccccatgactctgctccaccctgaatcccacccacttggtcccctgtcctcaccttacccacccttttatggcccaatttaaacagcac

SEQ ID NO: 108452 - DNA, 1712 bp, Homo sapiens
  misc_feature (46)..(46): n is a, c, g, or t
gcaggtacgaggccggtgttaatcggccgaggatgcagcccatgcnctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattag

SEQ ID NO: 108453 - DNA, 1718 bp, Homo sapiens
gtccagttccagttctacaacaacctgttggagcacatgcagtcccatgcagctgacaatgaaaacaacattgcctccaaccagtcccgatcgccacctgctgttgtagaagagaagtggaaacctcaggcccagaggaacagtgccaataacaccactaccagtggtttaacacccaacagcatgatccccgaaaaggagcggcagaacatcgcagagcggctgttgagggtcatgtgtgccgacctgggtgcactgagcgtggtcagcgggaaggagttcctgaagttggcccagaccttagtagacagtggtgcccgctatggggccttctcggtcactgaaatcctgggcaacttcaacacgctggcgctgaagcacctgccacgcatgtacaaccaggtgaaggtgaaagtgacctgtgccttgggcagcaatgcctgcctaggcatcggtgtcacctgccactcccagagtgttggccctgactcctgctacatcctcacagcctaccaggccgagggcaaccacatcaagagctatgtgcttggtgtgaagggtgcggacattcgcgacagcggtgaccttgtgcaccactgggtgcagaacgtgctgtcggagttcgtgatgtcggagatcaggacagtgtacgtgacggattgccgggtgagcacgtccgccttctccaaggccggcatgtgccttcgctgctcagcctgtgccttgaactcggtggtgcagagcgtgctgagcaagcggacactgcaggcccgcagcatgcacgaggtcatcgagctgctcaacgtgtgcgaggacctggcgggctccacgggcctggccaaggagaccttcgggtcgctggaggagacgtctccaccaccctgctggaactcggtgacggactcactgttgctggtgcatgagcgctatgagcagatctgcgagttctacagccgggccaagaagatgaacctcatccagagcctcaacaagcacctgctcagcaacctggcggccatcctgacgccggtgaagcaggcagtcatcgagctgagcaacgagagccagcccaccctgcagctggtgctgcccacctacgtcaggctggagaagctgttcacggccaaggccaacgacgcaggcactgtcagcaagctctgccacctcttcctggaggcgctcaaggagaacttcaaggtgcacccggcccacaaggtggccatgatcctggacccgcagcagaagctgcggcctgtgccaccctaccagcacgaggagatcatcggcaaggtctgtgagctcatcaacgaggtgaaggagtcctgggccgaggaggccgacttcgagcccgctgccaagaagccccgctctgctgccgtcgagaaccccgcagctcaggaagatgatcggctaggcaaaaatgaagtgtacgattacctgcaggagcccctcttccaggctacccctgatctcttccagtactggtcgtgcgttacccaaaagcacacaaaactcgccaagctcgccttctggctcctggcggttccggccgtgggcgccagaagcgggtgtgtaaatatgtgtgaacaagcgcttctaatcaaacggaggcggctgctcagtccagaagatatgaataaactcatgtttctgaaatccaacatgctttaagacttgacttcgggggaaaaaaaaagaaaaagagaagataacattag

SEQ ID NO: 108454 - DNA, 1121 bp, Homo sapiens
tggtgccgtgccgccccgttcagagcctcggcgtagcagccctgcggggcgggcgagcccagcttggtgccaatgcccgcgatgctgttgagcgtggcgatggagacggcgccgatgcagtggttggtgtaggtcttggagagcttggccgccttggagagcatctgcatccgagtgcctagcaagttcttgccgatggctttgttctcgtaccaggtcacatcgccctcgctgcagtggtcccggggccgctggaagaacgccttgcagagagggttgcgtttcgacaggtacttgacgaagctggcgtaggggcagaactcggtgcccgtctcatacatgcggggcaagttctcctcgtcgctgctctcggcgcgcttcttgctccacgacgacgagcgcgacttgtggtagggcccgagggacttgaagtagacgaacttgcgaccgtcctcgtccatggccagcccaaaagagtcctcctccaactcacgctggttctcgcgccgcgggtacagaagtacatgcacgtctcgaaccagaccttgttgagcagcccgaagggcgtgttggtgctgaagacgctggaggtgtacagcttgcgcaggtcggcgcgcgtgatggcttgcttctgcaccaccggcccggcgccctgctcctcgagcttgcggatgaccgcggccagcgtcaggttggcgctgcgcagctcggggtccttggtgaggtcgagcgtgcggcagtacgggggctcattgaggtagcggttgagggagctgcggatgctgatgagcgacgacttgctgtagagctggccgcttttggagcgggcctcggcatagaaggagcgcagcacgcggcacagcgcccccttgtccatggtctcgaagtccgggctctgcgccttctcgctcaggtactcccggaagatgcgcacggcgtagcgggtggccagccgggtgttctcgctcagccgggcccgctcggggcgctgcagcacgtcggggtccagctcggagccgtccccgggcggcccaccgcgggcccggggcgccagcagtcgcggcggcgcctcgggctccagcgcggcgctctggtccatattgatcatatggaccggctcg

SEQ ID NO: 108455 - DNA, 352 bp, Homo sapiens
ctctttgtgctttgcagggggaacctggggtatgcaaaatgtgtctatttctgtttgttgtatacacatttccttccttggccttgcatggcctgtttatttttaaaagtgcaaacttgcaaccccaaacaagctggggccctgaggccgtcaacccctccagtctcccctgtgacccgcagtctgcgtcctgttcccattttcattcctcaagtgcatatatttttaatatcttgtagttaccctgctgtatactgtcatcttagggaccttttaaacaataccagtatgagcgggacctaccctgctgctcagtgaccccaggcagtgtgtcctaaggtggtgtgtcctg

SEQ ID NO: 108456 - DNA, 703 bp, Homo sapiens
ggacgggtccctggtcgtgcctgtcagagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggtttgtatttaatggagttaacaaaatcttttttgacaaaatcaaatatataacctgtgcaactgcttttcattttaataaagctagtgtttgttttttcatacaaaaaat

SEQ ID NO: 108457 - DNA, 283 bp, Homo sapiens
ccagtttggagggcagtggaactggggtgaccaacaatgaggagaggatgggaagatatttgctcaactttataccagtgaatctttctctagttggctaacccagtggctatataaggggtgtataacctttgattagttaatgaagaaaataaaacatattttcttgtctcatgagcttttctctaggatagctaaaatagtatttctttaatcagctaattacttttctctgtccttatgtgacacataattatgtgcacttgcatgatcatgaaccaca

SEQ ID NO: 108458 - DNA, 891 bp, Homo sapiens
ggacgggtccctggtcgtgcctgtcagagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagtattaggttactcttgatcaaatgacggaaatggaatgttgcctcgagatcttttgtgtcatacttttgaaatattgaagaatgccttaatctcgtctttatgtaagcagttgcagtaaaacctttttttcccccgtcgggagaattgtgaaaggtttccaaatagtccacatttgcttgcccttctgacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggtttgtatttaatggagttaacaaaatcttttttgacaaaatcaaatatataacctgtgcaactgcttttcattttaataaagctagtgtttgttttttcatacaaaaaat

SEQ ID NO: 108459 - DNA, 641 bp, Homo sapiens
taaataaaatatattcaaaacgttaacatttttctatgttaattttcaggttgaaggtttagaacagatgtggaaaaatgtttacttcagagaaaggggttgtggaggaatggttgtcagagtttaaggtaatatttactgttctactatagtaattatattccaaggaagttttgtctggcgtttaaattccagtgatttttgtattttatatgactgaaaggctaaatatctgtggaagtattttctatcaaatctcaatagagagttatttacacatagtaatcttttctaggaaattgattccttttttcccccaagtggttcaaagagtttattcatttgtttattttctttctttcatggcaataccacaaagtagttaaagtctctgaatgttgatgtcattctccagcgaccatcagtgattcattgtcaaaatgtttcttccagtttggagggcagtggaactggggtgaccaacaatgaggagaggatgggaagatatttgctcaactttataccagtgaatctttctctagttggctaacccagtggctatataaggggtgtataacctttgattagttaatgaagaaaataaaacatattttcttgtctcatgagcttttctctaggat

SEQ ID NO: 108460 - DNA, 1062 bp, Homo sapiens
ggacgggtccctggtcgtgcctgtcagagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgtcagagtttaagacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggagcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcaagaatctgtgtttgtggatatcctcgacaacatgtaagacaatataaaggtataagtagcaggataccagtttcttcaggattcatggtgcaatgttagacagggatttatttgccttttatatggaaatgggtcttactcaaaagcatggtggttttttacgacccgtaaattttcaa

SEQ ID NO: 108461 - DNA, 547 bp, Homo sapiens
gccgccacggaaatggggtctccatcaggaatagtagcctggagagttttcagatgacagtgccccctgtccccaaggtgggatcatggcatcatagacaagcaatgtgtggttccggtgccagggatggaagtttctggagcactcactgccctgccccctaatctgtgccccagcttccagaatcatctcctaccactccatcctccacggaaccccatgagctcccaaagcccagctgcggtctcgtcatgtacccacttaaaacgcaatagctcccaaggccccctgggagaagaccaagccccactgtgggacacggacaagccgtcctcagtatccacgtagaatctttttttaaaaagggggcggctgggcgcggtggctcacgcctgtaatcccagcactttgggagactgaggtggacagatcgcgaggtcaggagattgagaccatcctggataacacggtgaaaccccgtctctaccaaaaatacaaaaaattagccgggcgtggtggtaggcgcctgtagtcccagctacttggg

SEQ ID NO: 108462 - DNA, 358 bp, Homo sapiens
gggcgaatcacaatgtcaggagatcgagaccatcctggctaacacggtgaaaccctgtctctactaaaaatacaaaaaattagccaggcgtggtggcaggcacctgtagtcccagctgctcgggaggctgaggcaggagaatggcgtgaacccaggaggtggagcttgcagtgagccgagattgcaccactgcactccagcctgggtgacagagcgagacttcgtctcaaaaaaaaaaaaaaaaaaaaaaaggtactcatactggtaatacatactagaaaatatgtattgaacccaaatgtatacccttatggaattacaggtttaaaaatatttccagtgccctttctggtatggg

SEQ ID NO: 108463 - DNA, 166 bp, Homo sapiens
tgtttattcctgtgatccattaacatgagacatctttccatttatttatatcttttaatttttattccaacagtgttttgtagttttcagtgtatgagtctttcattagatttgttaaattaaatgcttagtattttattctctttggtactattataaatataat

SEQ ID NO: 108464 - DNA, 137 bp, Homo sapiens
acctcagccttccaagtagctgagaccgcaggtgtgtgccaccaagcccagctaatttttgtattttttgtagaaagagcactcactctgctgctcaggctggtctcagattcctggcctcaagcagtcctcccatc

SEQ ID NO: 108465 - DNA, 144 bp, Homo sapiens
ctgtgggagtgacctcagacctgatcttgagtagccactgaaggaggggagtgatatgattggaaagtcaactgagtccaaccacagttgggaaaacattttttgactcgtgtcattggaaccaaatagaatcaattaatagta

SEQ ID NO: 108466 - DNA, 884 bp, Homo sapiens
  misc_feature (18)..(18): n is a, c, g, or t
  misc_feature (60)..(60): n is a, c, g, or t
catcttaatacgactcantatagggctcgagcggccgcccgggcaggtttttaagcctcntggtttgtgttactttgttgtggcagccccagggactctgagttgatattctgtcaaatacacagcagaaattcgcctttcctgatcacatcacactgattccgggaccaagcaggatgtcacaggtgggggtcaagccaggcttgagaagatgggccgggctgggcctcagcctctcatgggcttctgtgggtcatggccttggcgttcctccagccctggctaatgcagtcttctgtggaggaatggcatcccaggccttcacccctccaggtcagccgtggctgccggccaagatggccgcgtgggcagcctcacattccttctcggcttttggccccatgtcctcggcactcaggtctgcagttcagcccaagtgttgagactcaggtatgcagctcagggcggccttaattaaccctcccatgggcctgggcaccgcctgcgcctcatcaactctgggctgctggttttgttcctgacgctgcagcctgacactgtgggcgggggtgcagtttgcgatggaaggctgcctccgaatcgaggaagccttgaccttgggaggggcctgccttttcgctgggcttgcctttctctgggcagcgttcgctcagcacttcagtgcggccgattcccctgggactgaattcacaccagccacgacgacttcccggctacttcacgttctctatgtttgcagctgttctttggtggcagaaaaagatgatttttcttccccccactcccattcccttttgttagtttctctccctgaaccacattttgagctgagtgaaggtctcaggttggcctttagagggagt

SEQ ID NO: 108467 - DNA, 187 bp, Homo sapiens
tggaacctgctcttagatctgctgctcaggagcaatgtgccctcgagcaagacgctgggttaatctcagcctccgcccctttttctattttaaacattttattactgtttttagagtcagggtgttgctccattgagcaggctgaagtgcagtggtgtaatcatagctcacggcagccatgaactcc

SEQ ID NO: 108468 - DNA, 476 bp, Homo sapiens
ctactggggaggctgaggaggcagaattgcttgaactcgggaggcggaggttgcagtgagccgagatcacaccactgcactccagcctggatgacagagctagattccgtctcaatcaataagggagatctgatggttttataagggattccccctttgctggtctctcactgtctctcctgctgccctataaagaggttccttccatcatgattgtaagtttcccgaggccacccccagccatgtggaaatgtgagtcaattacacctctttataaatcacccagtatcaggtatgtccttagagcatcgtgagaatggactaatacacctcccattggggttaggacttcatcatatgaattttggggagacagaaagatgcagttcaggctgggtacagtggctcagcctgtaatcccagtactttgggaggccaaggcgggtggatcacttgaggtcaggagtttaagacca

SEQ ID NO: 108469 - DNA, 524 bp, Homo sapiens
gggcttactgaagtaagcaatacattttcccaaatgcacaaatatcatggaattatgaataaaaatctgagtaggagtgtctatttttgttacaatatctctatgggagaacccgagacagaaagtgaaactggttgtaccccataagcctcttaaaacatggacttagggtttgctacatacatccagtgtggaaataaaatgcttctcggattttactgattccatcaatctaggatcataagtatgtaatcaggtatgtttcaggatattacattttaaaatagcattcttattttatttgtgtaatctcttgttgtcttccaaatcggttatttgggcacttgacttgggcaataaataatctcatgttttcttcttgagttctgtaaacagcataaaaaaggaggcaatttggtatcatcatctaaatgatgatgcatttcaaaagtaaagagttttgttcaatgctctccagattatctgacacaatccctccctggatgcagcatgtatttttaaag

SEQ ID NO: 108470 - DNA, 290 bp, Homo sapiens
caattttccacatgtgatacaaatttttaaatgtcctaattgtcaaagaaatgcagtatttcctgtttccatatacttggaaacatctctgacatctttagagatattagttatattcagaaggcaccacccttatttaaaaaataaactaaatttaatgttctaccagaaagtgctatgcatatgtaagtatatttcttcagcttttatgccagaaattcatatttaaactaaaacagaaaaacaataggcacctcccacagctcctaattttcatttcctctagtgag

SEQ ID NO: 108471 - DNA, 502 bp, Homo sapiens
tattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccagcctgggcaacagaatgagaatctgtctcaaaataaaaataaataaatcccttattatttcaacaatatgcacagcatcttcaccaggagattccatcttaagaaactactttcttggcttgttccgctg

SEQ ID NO: 108472 - DNA, 339 bp, Homo sapiens
ggatggatagagtgcccaggggagcaggcccaggaaccaaatttagatgaggaggtcagcaaaggcctggtggaggagtccatgtaagtcgaggccccaaggatgagtcgtcagccgctcgaagcgtgggcgggagaacattccaggcagggggaacagtgtgaggtgggaaagatctcggccagctgcagagtaggctgcctctgggccagagcgagagcccagagggaggaggtagaggaagaagcatctaggagcaggcagggccacgcctagcagcttgacagaggcacccaacaaggagtactgggaacaggaacagaccaggggctcaggatc

SEQ ID NO: 108473 - DNA, 472 bp, Homo sapiens
agacattttcttaaaggaccagacagtgttttaggcttgtgggtcatatcatctctggcacaggtactcaactctaccctgtaacacagagcagacacagaccatgtgtaaatgcatgagtgtcactgtgtggctataaatctttacttataaaaactgactgttggcccatgggctgtagtttgctgctgacccctgttttaagtcactaagttttgggatggtttgtcacataacaaaaggtaaccaaaacagtctaaaggaaagaaccaagctgctagcaaactatctctaccgataatttttcaggttactatttagtaatagtaacaattataacagccaacatatttaaagggcattacatgttacaaaatagtttcacatgaattatttcatttatgaagtcgctgcaatcagtgaaatagacataagtgattattaagtccattttactgatgaataagtaaag

SEQ ID NO: 108474 - DNA, 326 bp, Homo sapiens
attgttataagcttactgaagggcaacatggcagcacttatcacacttttaaaaatagggtgttatttttaagagttctgcttccaggaattcatcataaagaaataatggaagatgaagtatggtagaatgattagaagcttcactcagtggtcatgcagacctgctttgcattctggctttaccaccaatttgctgtgtagccttgaggaagttgcttagcctcttcaaccttcagttttctcatccggaaaaggagggtgacaataattcccatctcactgagtgatgcaaattgaaagggaggattcatataaagtggctat

SEQ ID NO: 108475 - DNA, 238 bp, Homo sapiens
atccgcccctgcaggcaacaactctctttaggtcctggtttatctttccttcctccagagcacccgagtaactgcttctctccccatctcccttacctgaagagcacacgctgcagatacacatctgcacctgcttcgtgctcagcagcgggtcgtgggaaccaccctacattgtcactcatctgtcacggctgcacagtgctcccttgtgacacaatgcacagcctataaccttttg

SEQ ID NO: 108476 - DNA, 364 bp, Homo sapiens
agagttcggggactgtggatagctcaggatatgtgtacttgcatcgaaccatcctgctgatatgaaagcattggtcgactgttctgcatgttgaattgtggggcagggagggcacttttctccttgacatttttttcttattatttgaaagaaatatatgttttaaatagtttaatttcttgattgatttacttttcttcaaaaatgctgtattggagttctgaatgtctctggttgtttgcacacagataactgcaaagaggttgtcattactggttacacgcaagccgaggccagatctcttacttaatgacttggggaaggcacaaaacatgagagaaaggtaactgccagccaggcttgc

SEQ ID NO: 108477 - DNA, 464 bp, Homo sapiens
ggtcaggagtgggtagggataaaataattcagccatactcagagttttgctcttggttaactgtgccaggaaggatgggctagtttggcaggacctgaaagagtggtttcttctttccttctttcttataaccacttcatctaccccacttctaagaagcttagtttctcagtcaatgaatgagtcctttggttgtggccatggcctgtgacactctagaagtaaaaattgtcctctcatttccttccacagtccatatttctttcatcttgataaatgccacagggggctatgtaacaagcccccattctctctcagctcagtttcagtggtggtttcctgtgttttcaaactgagagttcacatttcctagctccaggataatgtgagggtttttgaatagctctgatagtaactctggcagtaatctttgtatattaactgtggcatgttcagttgaccca

SEQ ID NO: 108478 - DNA, 277 bp, Homo sapiens
cttcaagttttcttttctgggcccatggcttacagcttgctctgcgatctaactaggctaagttcatcatgtgaaaaatggcacctctagtggcagaaggccccttggcaccagctgcagtggcggcaggctctaagacagaagagcgccacctactgcaccatggacaccgcagtccccctttccactcaacaagggacccagcccactgccactgccatcacagccaggataaggatctcatccaggggcaggctttcagcgcaccttgcgcact

SEQ ID NO: 108479 - DNA, 387 bp, Homo sapiens
tctgtccgggcttcagttagctctgagttggcaaggactaactgcttttccagctcttctgtctgaaaggaaagtacaaattgaacagtgtctgattatgacagtgggtaatataaaataaatatagactttggaaaacaaatggtattattttgagaacaaaaataaaagttcgttgtgaggctgggtgcagtggctcatgcctgtaatcccagcactttgggaggccgaggcgggtggatcacctgaggtcaggattttgagaccagcctggccaacatggcaaaatcccgtctctactaaaaatacaaaaattggccaggcatggtagtgggcgcctgtaatcccagctacttgggaggctgagacaagagaatcgcttggacc

SEQ ID NO: 108480 - DNA, 422 bp, Homo sapiens
ctacgaagaactattctttttccctatttacaggtgaagaaactgaggcccagaaaagttaggtaacttgaaaaaggttcacacagatgagaactagctgatctgggaggaagttaagtgagtaagcaactaaaagaagagggccgggcgcagtggctcatgcctgtaatcccagcactttgggaggccaaggcaagtggatcacctgaggctgtgagttcaagaccagcctgaccaacatggagaaaccccatctctactaaaaatgcaaaattagacgggcgtggtagctcatgcctgtaaccccagctactcaggaagctgaggcaggagaattgcttgaacctgggaggcggaggttgcagtgagctgggatcgctccattgcactccagcctgggcaacaagagcgaaactctgtct

SEQ ID NO: 108481 - DNA, 403 bp, Homo sapiens
atttaattggcttaaagaaaaataagtgtttataaaaattgttctctcagaaaaagagaaattaaccaaagtgcttttcaacttcatgtaaccgataaaatttggtaaataagaatattattggccagacctggtggctcatgcctgtaatcccaacactttgggacgcttaggtgggaggactgcttgaggtcagaagggcaagaccagcctgggcaacatagcaagaaccctgtgtctacaaaaaataaaaaattagctgggtggggtggtgcatcccagctacttgggaggctgaggtgggaggatcccttgagcccagaagttcgaggttgtagtgagctatgattgcaccactgcactccagcctgggtgacagagcaagaccttatctctaaataag

SEQ ID NO: 108482 - DNA, 605 bp, Homo sapiens
aacaaaagaaaggaaaaataatcagacgggcatttgcaacacaagaagctagaagatgattaaataatatcaacattatgtaaagtcaaaaggactaggcagggcaagacggctcacgcttgtaatcccagcactttgggaggccaaggcgggtgaatcacctgaggttaggagttcgagaccagcctgatcaacatggtgaaacccccatctctactaaaaatacaaaaattagccgggtatggtggtgagcgcctgtaattccagctactcaggaggctgaggcaggagaattgcttgaacccgggaggtggaggttgcagtgagctgagatcgcgccattgcacttcagcctgcgtgacaaagcaagactctgtctcaaaaaaaaaaaaaaaaagactaaaactcagaaattgttctttcagagttaaagaaagctattctaaagggagtagaatttagatgtgtcatccacatactcacctaataaaaatactcaagaaaggtttttagcctaaaacaaatgagtaagaagaaaccttaggatagaggatgatgaaaaggagggaaacagtggttagccacagaaactgtcaattagatta

SEQ ID NO: 108483 - DNA, 215 bp, Homo sapiens
cttcttttcattggtataatttattgctacagtcagaatttcatttattacatgcttttctctttccagtatctacatattctcattcagaaaatctctagtctaatgataactatcaaaacattttgaaattggcaaattggctttccaagagtatacaatgagtatttgtgggttttggggttttttttgctttttttggttgtttttttttt

SEQ ID NO: 108484 - DNA, 270 bp, Homo sapiens
tttgtcttctcctcttaattttttaaatgctctaaaacgttcaaatccaagtgaaaagctaactcaatgacatcttaatacttagaaccccttcaggacattctaagaacagaattaggattgttgagatgtgtgtttaatggtactcctaagtctgcacacatctgactaccaacctgatgtttcatgtctgtctattgtgctttatttcatagagaacctttctcttgaaaggttactaaagtctaattaggatcattgcttgtaaag

SEQ ID NO: 108485 - DNA, 376 bp, Homo sapiens
ctttctcactctgtcaggccagatggtctcttgtttcagattctttgtagtgtctgctttaagcttgtcttttctgcttctccatttacatattggaatatggccttctcacagctcaccagagactaaacagtgtcccagttctcatttcctgggagacagaatctgtttggcttagcttggatcagatggctgctctggggccaatgagctgtggccagggatatagctcccgtagtttaaacatggccatcagagaccactcttggattgaggataattttcaggaaaaataaatgtcagtccaggcagagcctcagaaaggtatttattatactaccctaattgttcatgtcagaccaaaaatgcaggggcc

SEQ ID NO: 108486 - DNA, 864 bp, Homo sapiens
agattctggtgaaagagacagtcataaactatcaatccacacagtagaataagtgttacaacagagttatatacagggtggtctgagtacatagtttctcatgctggtgttccaggtagtataattttctgaaattaaagctggtaagaatcaacataccggggatgtgattaaccattcccaaatctcagaaagacattagcctaaactgtaaggagtgtaagataagccgtgctctagttaattgtaactgagggcatgtgctggtgatagataatgtgatggctgataaagaatactgaaaaccagagccacgggaatgtgtcatggcccctttccattagggggagtgcagccccatgccaaatgaatggtcccagctctctagccacaggtggctctgaagatttctagccacagacacccctggacaacacagtgagacctctctagccacagatagccctggagccctgaagtggagaagggcacactgttctgcttcttccatgtacagcctgttcttccagctttgcaaaatgctctgataaattaggagaacactttaaaaattgaccgctcaggccgggcaccgctggtcatgcctgtaatcctcgtactttgggaggccaaagagggtagatcatctgaggtcaggagttcaagaccagcctggccaacatggcaaaaccccatctctactaaaaatacaaaaaattagctggacctggtgacacgtgcctgtaatcccagctacccaggaggctgaggcaggagaatcgctggaacccggaggcggaggctgcagtgagccgagatcgtgtcactgcactccagcctgggtgacagagtgagactccatct

SEQ ID NO: 108487 - DNA, 632 bp, Homo sapiens
tctggggcactgacgggttactgggtagagggccagcttaggggagggtgtggtctgaaggtatgggtagggcaagacctgactccactcagtgatgtgtccccagtgaggcatcctccctagaacctgtaagtaacaggaagaccctaccctgaacagagctctagggatgaggggagggtttgaacccctgctcgcaggccgaggccaccccagtgaaagcttggctggacaatatcgccctaccgtggaaatgtcgttaaggactaagtcctttaaaaaaaaactactggggagaattttgtctcaggcctagagcctataatcactggcttctcccggccgttagtttgattttgtcttatggatatgcgaaattttgaaacaattgttttgtctttgctttggctactgggaagctccctatcatacttatgacccatctctccctcctgtatagaactttatcgtatttgtttctgtgtagcaacccaaccagttgtacattctttttttcactgatccttcatcgacttattttttgtcctttgtatgtttttcccaaaagcgacattgcattatttttggaaggaaatagctatgagtaaataaacaaacggcattgtgaagtt

SEQ ID NO: 108488 - DNA, 459 bp, Homo sapiens
ccccctcctactccctccccctccaggctctggttgatgggcagagagtcccagggcctgggggagggtttggaacattggagctccccattgggagctctggctgtcagctgttttccctcatgtgtgcttttagctggaatccggctctgagtgctgggacctctgctgacctgtgacctctgctgtcctctgtcctctgctgacctgggaggcatggagaggtcctgctgggggactgagaatggctttttgtttgtaggttataatattgcggttactgtatttcttttgttaactacagtgattctcatggggccagtgttttatttttttaataccatcattttttacagctggcttaagggaattttttcctctatgtttttgtatctgagggtgaaaaacattttgcctggatctagcaaaagagtactcagtaagttctatttaaattga

SEQ ID NO: 108489 - DNA, 589 bp, Homo sapiens
tgaatttgcattaattttttctcctcaaaatttttgagagctgtctttaaactcttctgaattcaattagctcactttctgtttacagttagctcctggtattatacaggtaccaaaatgctacctggaatactagtggttctgtgagatgataataaaaaatgtttgagatatgttatatgccatattctattttaagagattgcaataaacattggcttatttaaagtctagaggtgtccttcaatgaaaaaactaatactttaaccaggagtttgtagatcatacttgaccacaaaatcctctcttctcccagtatctgtcagcattctttgaaaaaaaaaaaagttatgtttgtgccagtttgcatattatatactttctattactaggaaatcttttgaaaaccaaggatttgttgcttctgctctagaaagggtttggggatggttgggcctggtggcttgtgtctgtaataccagcactctggtatttacttcaggaaggctggtatcagccttggctggaggatcgtttaagcacagaggttctagagcagcctgggcaacatatggagacctcaactgtt

SEQ ID NO: 108490 - DNA, 361 bp, Homo sapiens
  misc_feature (210)..(210): n is a, c, g, or t
caagacctagagcgtatcttaacttcctgatccctttagccagaaatgactgaagccctaagcacatatggtcctattagtgtccattttagtaatctggcaggttagtattttgtggtattttttcaaccgtcttgaactatttaagtttaaattccattttatttagctttttgtaaatatatgaggtctgtctctaccaaaaatatnaaaaattagctgggtgtggtggcgggcacctgtaatcccagctacttgggaggctgaggcagaattgcttgaacctgggaggcagaggttacagtgagccgagatcacgccactgcactccagcttgggtgacagagcaagactccatctc

SEQ ID NO: 108491 - DNA, 337 bp, Homo sapiens
gcattttattcatgttaaaattttaacagtcattttataactaattgagatacaaaaggtcaatgttttatccccagattttggttcatacctctactaaacagcagagctgggatttaaactggtgtctgataagagatggtcttaatccttaaagcatgctgcctttcaagcaagttaaaggctaaaacactggccaagtgaacagccagatcagatagtggctaaataaagtaaatgtaaataaaacaatggggggtgctattagagattttaacaagtagtaatgcttaatgcaagtagggttgcattgagatgcataaggcaagacgatctc

SEQ ID NO: 108492 - DNA, 309 bp, Homo sapiens
tggggaagtgggctggaaaagcagcccaggctaggcaggatggtacacagcctcagtcgaggcaggaaccctggattcgactcccaaggtgatgggagggaagcctctgcaggtttgaataggagacacaggtgaagggtataggattcctagggcaggaagagaagtccataaagaacaattgtccagctgggaagagggcagtggaggtggaagggaggggatcacagaaaccaagtagtaaggaacctcagagaccatctggcccaggtctggcctccagcaggtaagtaacgaacatcactgtgc

SEQ ID NO: 108493 - DNA, 284 bp, Homo sapiens
tccttaagtgagggggtatatagcactcttggcttgctgtacttcctccactctgtttatcagaggagttcaggtccagatgagcaaactgctcctccaggtcgagggcattttctaccaccacatgactcatccctgaagagaagtggaaaatcaaggtcgtccaccataagtatgagaccaaatatcctagtttgttcatttttaaaaattatttctttatttccccccacccccaccccactgggttagctcaaatggccagtcttcaagctctgaaattc

SEQ ID NO: 108494 - DNA, 283 bp, Homo sapiens
acacactccatggggcctggttctgaaatggaagtatagccgtggcgtcttgaagctgaccagggaggtagtctagtccaagttgctcattttacaggttatgactctatgacctaattcaagtgaagtgaaagccacagctggttgtgttgagctttgaagactgttccctgactctcatgcaccatgccatctcatcattgatcgtgagcatctccatgtagttggaattagctctcaggggcaactgggtcatatatggagatagtagatgcccaagaaa

SEQ ID NO: 108495 - DNA, 643 bp, Homo sapiens
  misc_feature (38)..(38): n is a, c, g, or t
  misc_feature (185)..(185): n is a, c, g, or t
caaggcagtagcagcagaaagtgaatctggagaacctnccctgtgtgcagtgttaacaagctgagatttacaggagagacattatgatctgattcaccctttaaagtctgtggaggatgactgggggtggaagggcagaataaatcccagctactgagggaggctgaggcaggagaatcacttgnaacctgggagatggaggttgcgctgagccaggatcacaccactgcactcctgcctgggcaacagagcaagactccatcaaaaaaaatacataacagacccagtagtatgttgtcttcaagagacccatctcacatgcagtgacacccataggctcaaaataaagggatgaaaagaaaaatctaccaagcaaatggaaaacaaaaaggcaggggttgcagtcctcatttcagacaaaatgactaaaccgacgaagatcaaaaaagacaaagaatcacattacataatggtaaagggttcaattcaacaagaagacataactcccctaaatatatatacacccaacacaggagcacctagatccgtaaagcaagttcttggaaaccttcaaagagacttaaactcccacacaatagtagtgggagatttcaacaccccactgacaatattaaacagatca

SEQ ID NO: 108496 - DNA, 415 bp, Homo sapiens
gttgggtggaagtaagctcagacttgactccgcctgcattcctcgcaggccctggaagacttgccttctctgtcccatttccggatagcggaaatgcactcactccttcatttattattcagtaatgatggaattcatttgttcatttacttaatattgaaagagcctgtcctatgaaccaggcgctgttctaagtacttggaatgtggcagtgagcaaagtagaggaaaattcctgccctcgtggagcttcttagtggaaagaggcagacaaaacccaaaaccaaacaatcagtaaaatattagaaacggatatgttctatagagaaaaatggagcaggggaagagataagtttcacttggttgggcagggggttggaggagagtttgcaattttgcataagttggtcagggaa

SEQ ID NO: 108497 - DNA, 150 bp, Homo sapiens
gattacaagaaacagtaaaccttagtttttagaaggaattgagttacattgaatagttttatgcgcattttttgtcaatagatcttactgaaaatgggcttgggttggccgggtgcggtgcctcatgcctgtaatcccagcactttggga

SEQ ID NO: 108498 - DNA, 376 bp, Homo sapiens
tatagatccagtgctacaccagggccttcatgtgtacagaatcctgagctgtgaagcaagacaaacctcagttcaaatccctgctctacaactaactcaccaaatggccttaagcaagcccaactacttaatttctgagtttcaatatcatcttgaaaacaggggtttcttcattcacttaatcatccggcaaacactgtgtgtccaccaagccaggcactgttctaggtcctggcaaactggcactgaacagcaggcaactccccttccagctgggaggcagaaaacaaatacataacagaaggttaaaaagtactttgcagataaccaagcaggggctgctacttttgttgttgttgtttgtttgagacagagt

SEQ ID NO: 108499 - DNA, 172 bp, Homo sapiens
tgtaggctctgggcatgaaggattttcatcacacacctaatgaggatcgcttggccagtcgccctactaccaagaacaaaccacggcttttgggacatgtagtgctattctccccacccaagcatggcaagcaggagccagagtgagctactctcaattagctgtccttccc

SEQ ID NO: 108500 - DNA, 196 bp, Homo sapiens
aggatagcaagggtgtggcaagcatggccaggggcaggctgttgcaaggctgccatcctactttccaaagcctccatcgtccactctgcaggttatcaccgaaaatctgtgtgattccacctcaatcttgcatgcctttcgaaggcttccagctctttggttcagtggacagcttccgtcttacaaacaggctgaa

SEQ ID NO: 108501 - DNA, 165 bp, Homo sapiens
gagagatgtaaaaaaagggagtgagccctgcagtcctctgggagacagccctccaagcagagaacagcatgtggaaaggctctcagtgggatcctgcctgcatggcatcaaggaggccagggtggcagaaaacaagaagagtgggtggaaacacagggagacaaa

SEQ ID NO: 108502 - DNA, 711 bp, Homo sapiens
atgtaagaatgagtatctgattggctacctgccagccaatgagggttcccccttgcctacctgtgttggggagtgcaaggctgtcaccaggagggcaggttagggtgaatgtggcagcccaggtgaggtagacctgatgattgttcgaatgtgacactttctccctgtcatagcccagcagcccctttagtttgtgactctgctgtgcctcccaattaggcctgctgtggacatctcacttctggctgaactttgggctgggttttgtgatgctctttggtcagtggaatgtcatggaaggcccatgaatagagtgcttgaatgtgcttgcatgactttacttggcctctctgttctgctaggtaccatgagaaaagcatgtcctagattcacaggtggaacttcctggccccaacctgttgcttaactctcagtcacccagtgtacccaaacaccagtgagcaagaaataaatgcctactgttgttcaataccaaaatccttttttcccctcttgcttttggtcccacagtattgttgcagtagaaatctgaccaacacagcagacaagttgactaatatgtctgctctttggccagaaaaccaacaagagccagaatggacagtgatgatggaaatgaattagttgcatctagggccatgtaacttgccctccatttgaccaaagctgaatttcattgaagtgtccatt

SEQ ID NO: 108503 - DNA, 341 bp, Homo sapiens
cctggcatcctgctaggccccccacagcaaggacataggaagcacatccgggaatgtgacacccacagagcacacatgtggccctcaagcacagtgcttcccctgaggcctgtgagaaatgtcatcacaaccctacaccacctcctgtgaccacaatgaatggcctggcctttgctcaaaccacagacaaaggctgcccttcagtctgtcacaccagaagccatggccttttgatgccctggtgaattctggctcttggtttgcatcagatgagcccccactggtgcagttctccgaattttggtgtcattgacttgcacaagcttttgtctacatctctg

SEQ ID NO: 108504 - DNA, 832 bp, Homo sapiens
ataggaacctgttagtcagagtgggaacgggccaagggtcactaggtcactgtttttttgttggtttttttaagttttataattaatataaaaatggggtctcgcgatgttggccatgttgttcttgaacttttggcctcaagcagtcctcccgcctcagcctcccaaagtgctaggattacgggcacgagccaccacatccagccaagctgggtcactttgaactgaggccagggtggattgcagacgtggggcacatcccagcccctgaattcagggtccaccatcacacctgctcctgcctagcatcctgagagggctgcccagaaaagagcttttacaaaccagctgttgataagctcagaattttagaaaccactgtcttcattataagggcataaggtacaaggatgaaactccccctgtctttactctttcttagaactctgggtttttacatcccagtgaaaggggatctgtcctctggttgtgaggacaaggcatgtctttatgtgttaaaaagagtaaccactgacaaggttttttttgatccttttaaaatttactttcgacctgtaatcccaggactttgggaggccgaggcaggtggatcacttgggttaggagtttgagaccagcctggtcaacatggtgaaaccccgtctctactaaaaaatacaaaaattagctgggtgtggtggtgtgcacctggaatctcagctattcgggaggctaagacaggagaatcgcttgaacccaggaggcagaggttgcagtgagccgagatcacgccactgcactctagcctgggtgacagagcgagactccatct

SEQ ID NO: 108505 - DNA, 464 bp, Homo sapiens
cctttgttttgccctctgtgggattaaccccatctcttcatcaagtaaaagcctgtataccaattcacagactttcttttcagcagaataaatcttactgttgatacaatcttttgaaatggaacatctttatatttttatgtaaagtatgattttcctgcaattctggctatgactttgtatagctttcctacatgattctgtggcttcctcagacctgtggaagaccttgactctaaatctgagcagacagaaagctaagtgcagaatgatattcttcaagtaagccattcaccccaagaagaagtaagagggggggaaaaaagacaaaacaaaacagtgtggaaatgtgtctaaactagtgtccccaagggtatcccaaaaccatttattctatggaatgttagtaactgttgtgctttaaaagttacaaagatctgataagtttgggaaagcctgtgtta

SEQ ID NO: 108506 - DNA, 961 bp, Homo sapiens
tctgcacaccaggggagcacacgggagctggagagcgattactacctgggtggttatgacattgacagtgaatacccaccccctcatgaagaggagttcttgagtcaggaccagctgcctcctcctctcccggaggacttcccagaccaatatgaggccctgccaccctcccagcctgtctccctggccagcacactgagcccagactgcaggagaaggccccagtttcatcctagccagtatctccctcctcacccattccccaacgaaacggatttggtgggcccgcctgccagctgtgaatttagtacttttgctgtgagcatgaaccagggcacagagcccacaggcccagcagacagcgtgtctctgtccttgcacaattccagaggcacctcatcctcggatgtgtctgccaactgcggctttgacgattccgaagtagccatgagtgactacgagagcgtgggagagctcagcctcgccagccttcacattccctttgtggagactcagcatcagactcaagtgtagacatcacatcttgggtacttcaccctgtttgttacagaaaagtggaagcagattggctgggcttctgtcccagtggagcattgtctgtggaatgagaagggaatactgtatttttccactagaaacttcttcacaagtcatactgtcccaacaagcaagcttgattccagttgggtgaaaatgaaaggctcagaaattgtttttgagaggtgactggtaatccttgatgtaggtacctatgttcacagctaaaaatgcaaagagggaaaaattatttcacccactaagttatacagccagtcttgtatggctttgtgcagtattgtgccctggaaagtgttacagcatcagtccttgcagtattataatgatgtggaaagtagcccttagcgaagaaaggaaccatttttaacaaccgaaagggttt

SEQ ID NO: 108507 - DNA, 191 bp, Homo sapiens
cctgaaatgccagcactttgggaggccaaggcaggtggatcgcctgaggtcgggagttcgtgaaaccccgtctctactaaaaatacaaaattagctgggtgtggtggtacatgcctctaatcccagctactccggaggctgagaacccaggaagcagaggttgcggtgagacgagatcgtgccactgcact

SEQ ID NO: 108508 - DNA, 322 bp, Homo sapiens
aggctgaggcgggagaatagcttgaacccgggaggtggaggttgcagtgagccaaggttgtgccagtgcaccctagcctggtgacagagtgagactccgtctcaaaaaaaaaaaaaaaaaaaaattaaaaaatacaaacttactacctacctccttacaacctaccctcacagtattactgtgaataaaagtgtgtgtagcactgggaacactattcacagagcactcatgaatgtttgttctttgttattagttactagagaggcaaatgtctgccagggctgaataatatgtgtgaattggtgattgtcgcacatatcta

SEQ ID NO: 108509 - DNA, 385 bp, Homo sapiens
aagtccttttaagcctacctttcaataacatctaatattattaaaatattaattgcatgtaaattctctttaaaaactgccagagagagaatatgagaaacaaagagttaattttcctaaaatgcaaaggcctgtcacaaatcaatgaggaaaagggaaaaaaaccaataaaataacaaaggatctgaactgggagtgtaaggaaaaattgacatattaccatagttgagtaagtaacacaccttacttagcaatgaatttgaaaaaaaattacaggatatttctatacaaggaataaactttgaaatcaataacagtagtatgacaacaacaaaagtctgtatctgggaaatttgaaatacacttctaaataactcttggattg

SEQ ID NO: 108510 - DNA, 376 bp, Homo sapiens
acttttactatcattcttgatcttaactggaaacactccacatttgtatcattaaatccctgttttcccttcttgtaaaaagtaaaaatcaccacattataacatgacattttaggtttggttggtagtttcagttaagtaaaatagaaacattgttgaaccccatccccagaatttctatttcagaaggtctagggtggggtctaggaatcaaatttccaggtgaggcttatcctgctgatctgggaaccacatttagagaaccgcttgcctagcataacttcattgttctcttttgcttcccaaatgctttttaaaaaacaaatatggtgatttttccttttttttttttttctttgtcttgagacagggtctt

SEQ ID NO: 108511 - DNA, 319 bp, Homo sapiens
tcatcaaggcctatgtcgacctaattattcttgctatactttcaggcaactaatcaggtcacagtatcgggctaagggatttgcaaaccactcagtcctatcatgattttttaacaaaaatgaggactggaaagagagagatcatgttccaaactttaccatacatttgtcattaaattctgaactcattatatatctttgaaattttgcacaaattctttcaaattgcatagttgtggttatagactgttgggagtagatggtccttgggacctctcattccatgcagaacacttctgcccaccaccactaacactga

SEQ ID NO: 108512 - DNA, 548 bp, Homo sapiens
cagccagtaagcggcagagccatggttataatcaggtcagtctggctttggacttctagtttttaattataatgcttaattgccattggcctcacagtcactctcccccttgtcatgggtgcctgactggagctacccacacctgcataaacctctgaagagcaggatggacctggcacattcatgggtttatctggagactgcacaactatgagttggttttcaaaagggtgttttgaaaaccaccacacattgctggatgtcataaggcttcatggcttagtcagaattctttcatagctgtggctgcagcttggggaactatagttagaagtgcaggaagaacatggggagggataaagtacagaatctctgcaagacaaccccattggtggggagacagacttgaggccgctttattggacaggagcctgactcagaatgagaagtgaagatgttcttctgccagcagggtggcactggaggagctgtgatatttcagacctttcttgggatgagttgactacagtgcttcacatcgaatggct

SEQ ID NO: 108513 - DNA, 135 bp, Homo sapiens
aaatgtggaaatgaaagagaactggaaaggggaaaaaagggggagggaaactagctgatgatactggtgcaagggaagtcctaacctagctcctcaatggctgtgttggggaaggacttcagcatcagtctctcc

SEQ ID NO: 108514 - DNA, 103 bp, Homo sapiens
tcttatgtgcagaaatgtcttgtaattaggtttgggaaaggtgtattgcttagttacaaacacatctttttaaaaaggtcctttcaaagggtcctcaggatgg

SEQ ID NO: 108515 - DNA, 225 bp, Homo sapiens
ctagaggcaaacagactagcttttagctctgtgaccttaggaagtttgctttatatctccaatattcaattatcttacctttaagatggtatgttacttacccttcagagttctctacgggattaagtatgataacatataaaatacccagcaaggtattaggggttcatagcagcagtgttcagggatgggggtgttagtcagatatagtgaactattcaaact

SEQ ID NO: 108516 - DNA, 806 bp, Homo sapiens
  misc_feature (787)..(787): n is a, c, g, or t
  misc_feature (789)..(791): n is a, c, g, or t
  misc_feature (798)..(806): n is a, c, g, or t
tgagagaaaggatactacgtgtcctgccaattttagtatttattctggaatcccaggcttctgcaagctgttgggttgggtttttttaatgtgtgtggttttccttagttgttgaaggagtttcagaaaaatcttagatgaggataagaagggcagtataaacccaaaatcaccttttcttccctttcccttcctttttttgctccatctcagcttcctaggcttgattcatggagggagggacaagccctggggagagaaaagcacagaatttgagtcagtagatctggtttccattcctggttcaccctcttgctgcaaccctgagaagttacttcacatttctcatccttacctgaccccatctataaaatgaaaatcaagagatccatctcacagggttattgtgaataaaaatgtgtttgaatgtttattacgtattgttgagagttattcagatatgattctcatcttcctccaaggctacccagaagacacgtgtatgtgccatttatttcctcttccatgacatcactactgcctcctgccacccacagacatattccattcaaaactgaaatgggaagtgttcctagaatttcctatattgtggtgttttctggattttaagtactatctagtgctagggatgtcacttaggctgcttttggctgcaagtaatcaattacctcaatcaggatctcagcaagaaacagcagactcagattaggattatttgaggagggttatttatttatttatttatttatttatttatttatcgagncnnngtctcannnnnnnnn

SEQ ID NO: 108517 - DNA, 358 bp, Homo sapiens
ggtggttcagacacctctatagcatttatgccctatgaacactgctccctcaaacaagacactactccagcacccaaggattactacgcctaactccaaatctcactcaaaccaatggcttcttcatctaccgccatccttgcaacaaatccttagcacaattctcagagatgctagagggcacagataagtaattcctttaaagtctgcctttagtttctcttccttttccatgcatgacactataggcaaattctatcatccacatgattctggaaagatccaagcttagtagcaggcagttttttgagacctctgatagatcagggactgctccattctgatgggccccttgcca

SEQ ID NO: 108518 - DNA, 269 bp, Homo sapiens
gcaggcagatccacagagacagggaggggaagtgtgggtgccagggctggggagggaacggggtttccttttggaatgatggaaatgttctaaagttgattgggttgatggacacacagctttatgaagacaataaaagaaatcaaggcagggcacggtggctcacacctataatcccagcactttgggaggccgaccgaggtgggtggatcacgaggtcaggagattgagaccatcctggctaacaccgtgaaaccctgtctctaatt

SEQ ID NO: 108519 - DNA, 431 bp, Homo sapiens
ggaagtgtagtctatagtagagtcttcaaacaagggtctacatactcctgggaatattaaactttctaagggatatgcaggcataaatagctttaagggaatgcaaattcagatcgcagtgcccatgtaaatcctttattaaaattgacctacataaaaacatatccatatcaagggatcatgccagttctttttccctgctgccttttggtaatcactggtctcccattttacaaaagaaacctatggcaagttgtgttttgcagaaatgaccccaacaatatttaaagtctcatacccttctcgaaccttgccactacccttatcaagatgtggagttacgtcccttccctttgaacattaacagactttttttttttttcaaagagttagagggtctccttataggggcctccctgtattacccaggc

SEQ ID NO: 108520 - DNA, 1606 bp, Homo sapiens
acccacagcactcattcctgaagctactggttggttccctgagaggtcccagaactctgcgaagtgagtccagcgctgagattttccttgcagatctatcaggatgagcatccaggccccacccagactactggagctggcagggcagagcctgctgagagaccaggccttgtccatctctgccatggaggagctgcccagggtgctctatctcccactcttcatggaggccttcagcaggagacacttccagactctgacggtgatggttcaggcctggcccttcacctgcctccctctgggatcactgatgaagacgcttcatttggagaccttaaaagcattgctggaagggcttcatatgctgcttacacagaaggatcgccccaggaggtggaaacttcaagtgctggatttgcgggatgttgacgagaatttctgggccagatggcctggagcctgggccctgtcctgcttcccagagaccacgagtaagaggcagacagcagaggactgtccaaggatgggagagcaccagcccttaaaggtgttcatagacatctgcctcaaggaaataccccaggatgaatgcctgagatacctcttccagtgggtttaccaaaggagaggtttagtacacctgtgctgtagtaagctggtcaattatctaacgccgattaaatatctcagaaagtcattgaaaataatatacctgaatagtattcaagagctggaaattcgcaacatgtcctggccacgtctgataagaaagcttcgttgttacctgaaggagatgaagaatcttcgcaaactcgttttctccaggtgccatcattacacgtcagataatgaactccaaggacggttagttgccaaattcagctctgtgttcctcaggctggaacaccttcagttgcttaaaataaaattgatcaccttcttcagtgggcacctggaacagctgatcaggtgcctccagaaccccttggagaacttggaattaacttatggctacctattggaagaagacatgaagtgtctctcccagtacccaagcctcggttacctaaagcatctgaatctcagctacgtgctgctgttccgcatcagtcttgaacccctcggagctctgctggagaaaattgctgcctctctcaaaaccctcatcttggagggctgtcagatccactactcccaactcagtgccatcctgcctgccctgagccggtgctcccagctcaccaccttctactttggcagaaattgcatgtctattgacgccctgaaggacctgctgcgccacaccagtgggctgagcaagttaagcctggagacgtatcctgcccctgaggagagtttgaattccttggttcgtgtcaattgggagatcttcaccccacttcgggctgagctgatgtgtacactgagggaagtcaggcagcccaagaggatcttcattggccccaccccctgcccttcctgtggctcatcaccgtctgaggaactggagctccatctttgctgctagggaaggcgtgcccagtggggtagagaaatccaaagttctcttccaggcacttggacactaaaatctactatgtgggtg

SEQ ID NO: 108521 - DNA, 218 bp, Homo sapiens
tgccctccaggaatgctgagtaaaatgagtgtggcggttgcccacattgcagcttctctctgagtatgggtttaaatctgactattcaatctagagcccagcaagcacaggcttcctttacagtgtcttctttgttccctcttatttttcttccttttttgattaaccaacaatgcttctttgtaataatttcaaaagaacatcttgatagattgcaa

SEQ ID NO: 108522 - DNA, 718 bp, Homo sapiens
ggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatat

SEQ ID NO: 108523 - DNA, 437 bp, Homo sapiens
ataggtgtgagacaccatgcccggccatctattttaaaatatttaaactcaaggcaaactctagacaaaacagaactaaatctggaaggagctattataccagaaacaagaaaatgttaccaaaaatatcaaattgatattctcagaatttaagaaaacaataggtttgtaaaatgagaagaagctattacagaggggaccaattaggggataagagaaagtccttggacattagaaatgttactgcaaaactaaaaactggacacaggtcagacagtgcagagttcactgggttgcacatggaacatagtactcattctcctccctgcccacttccactgaaaaggaatgcatccctccccagataatggacccaaatacccacttccggccctttccgccattagccatccgccttcagccagctactactacca

SEQ ID NO: 108524 - DNA, 192 bp, Homo sapiens
tgcagcctcaacctcccagtctcaagtgatcctcctgcttccgaaaagtcggatttaacatcaggtcaccaaatgggtttttcactgtgggatcttttgatgagtttttttcgaatacatttccttggtttagatgtctcagacctgcttgaattctctagaagtcatgaatgtggcttctgtttgcaccat

SEQ ID NO: 108525 - DNA, 744 bp, Homo sapiens
gggaaaaatctcaaatggtgctaacacaaaatattttttaaatgcattgaaaggcaggtatttgaccaatgactaggcagaagcaaaactattacgattgggaaagaggaaagaatacataagcacaaagaatttggaagacttgggattaaacaaagactcaatttaaaccataagatccaagttatcttctcaatcaaactttacaagggtttataaccaagagcaaaaataaaagactgtgtttttactttttctcttgaaccttgcccttgaccaaaacctggttcaaagaatcaagggcaaaaaaaacactatgaatgataacaacaaaacaacccagtaacacaaaatacaaattcagagaagcatgagactatgaaaggagcagagtagataattcacagtcaaagttatgtatttatcatcatgttaagctatgcaccaacatgtatactgcaaagcaatcctttggaaaaacaaattaaacaatgagttaaacttgtgagcaaaaagtcaaaacgacgtgacggtgatgagttctgttggttttgttctatcctaggaccagactgttaacagccacctcagacttagccagctagttatctctaaaatattttggtcatgagagacacaaagtgagaacgcaaagtaaaaaattcatccaccactattgggagaaaaaaaaaatcattaaatgagtagctctgtcaatggtaactaatggtttccacgcatttt

SEQ ID NO: 108526 - DNA, 1119 bp, Homo sapiens
ctcccaaagtgctgggattataggcatgagccactgcacccagccatgattggccttttaactctcatgtctcctaaatgaaaccagtgagtgttcctttaactgagagttaaaacttcacatagttgtcatgcttagtatatttttaagtgtttcgtttctagagaactgaattttgtaaaatgtgtaaaactgaatttactagatcaataaatagaatcaggtattctaaagataattaacctagttactactatttatacctgcttaaatgcttgatgagttccctttcctccttcactcagacaaatcgcatatagtgatgtaactttttttttcagtctcaggaatgcaaagaccgtaatggggaaagctgtaggttgcagttccattagccctttttatttagtttccagaattgtcttgaggcctctggtgctagattgtaaccattttaaaattatgtttctgttctggcttgtagataagtagcagtttttattttattttattttatttatttattttttttgaaatggagtctcgctctgtccccaggctggagtgcaatggtgcgatctcggctcactgcaagctccacctccctggttcacaccattctcttgcctcagcctcccgattagctgggactgcaggcactcatcaccacgcccggctaattttttgtattttttagtagagacggggtttcaccgtgttagccaggatggtctcaatctcctgactttatgatccacccgccttggcctcccaaagtgctgagattacaggcgtgagccaccgcgcctggccgatacttagcagtttttaaaacagctagctaaacaagagttactgatactggttagggaaaaactgcgatacactgtgcttgaatccatcactgaaaaaaaataatgttcgtggaagtgttcttgggagatgtcttataggaatatgctaatatctaaatgccttggcaatctgtagaatattgaacataaagtattgtgtaacatggaacttcagtataggagttattctggtttttggaaaagttgttggtggagacttcaaggcagaattctgcttttatgtaataatgcgttatgttctacc

SEQ ID NO: 108527 - DNA, 263 bp, Homo sapiens
tagagttgtggtttggctgcgttgctcaggctggactcaaactcctggcctcaagtgattctcccgccttagcctcccaagtagctgggtgtacaggaacatgccaccacacccagctgaaattctaacctagccacatgaatgactattaagttctgcttgcttggtcttaaataatatttggttacttggtgtccacaagttagtagtggaaatggagacaatgtgtgaagctgcatttctggaagggcactaagtgcctc

SEQ ID NO: 108528 - DNA, 205 bp, Homo sapiens
cacttagtctgcaatattccaaaaggtagtggtatataacataattttaggtgttaagtaaataaagatgttttgattatctatcactgcataacaaaccaccccaaaacagcagcttaaaagaaaattattatttattttctcacagttttgcagtttgggttgctctcagctgagatagctcagctcttgtctgtatggcgtc

SEQ ID NO: 108529 - DNA, 370 bp, Homo sapiens
atggtgtgccagctcctggcaggtagagaggggacgtgagggagaagaaggggcacacaattattcaaagttctaatatgatgattctttccagtcagaggctgagttttctacaaaggagaaatgcaagaggtgtaggtttcaattaattgtaactctcttccttgaccaaaggatgctcaggtggaaacagagagaaagagggaggaactagggaaaagaaggctgaggaagaggcagggagggttttgcaaagatgagcaaagccaggcagtgaatcaccgtgggacacagaactcctgaggctgaaagccagacttttggacgcttaaaatccagatcatccccaaccctgcccaggttcccaggt

SEQ ID NO: 108530 - DNA, 1945 bp, Homo sapiens
  misc_feature (234)..(234): n is a, c, g, or t
  misc_feature (238)..(239): n is a, c, g, or t
  misc_feature (247)..(247): n is a, c, g, or t
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggccntgtnncccatccncaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcac

SEQ ID NO: 108531 - DNA, 1870 bp, Homo sapiens
  misc_feature (234)..(234): n is a, c, g, or t
  misc_feature (238)..(239): n is a, c, g, or t
  misc_feature (247)..(247): n is a, c, g, or t
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggccntgtnncccatccncaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcac

SEQ ID NO: 108532 - DNA, 311 bp, Homo sapiens
accattttattattcgagatttccgctgttgccaggtattaatcaatgtattatgcggttcacttgggcaagctgtgcagaggagggtgcccctagggttaccacagtcaagagcgagaaaagtgttttagacatgtacacaacatgtggtttactattatcattaaatgaggtgaactgggactctatacatatggattttgaattgcataaattttgattgatatcatttgaagactgaggctctgaaaggctagattttgtgaaagacgatacacagaccagctattaccacatacaatcataccagg

SEQ ID NO: 108533 - DNA, 621 bp, Homo sapiens
  misc_feature (342)..(342): n is a, c, g, or t
  misc_feature (458)..(458): n is a, c, g, or t
cctctacaagtctggcagaggttgtgtctacatgaaccttaaatatttagttaattaaacacagtcagccaatttagattcaacattgtgtcttcttcttgttagcatggttcctggaattgaccaaggaaatttgcattggaatattatgagactatcatttgtgtttcgtttttgcctcatttcctgcagagggatgctaaagaaaattattgcacagcaaaaaattaaatccaatagcaaaactttttagcaaactgagattaatatctttgtttagtattttgactgctgctttacaaatctcttaggcttcatggccattaacagaaggaatctttnagtacagatgtcttactacaaatatctgggggctactgatttctcacccaaaagacttaccgttcctgtgggaatttccgggtgcttttcccctctcaaagtgcaacttctgtcancatcatcatcacagtcaaattcgatgttagggagaaaattgcccatggaagtaagactactatttgagtttcgctttaggaatctgcagtacatctgcatggtagcattttaaaaaattattaactagtgttttattaaaaagataaacatgctcatgttaag

SEQ ID NO: 108534 - DNA, 312 bp, Homo sapiens
cagccatgctgttttcctttagattctaaaatggaaaaaagatttcagacccttgttctgaagtgcaggaacccactaatggaaaatcaggagcaaaaataagtgagagagagcatggtgaatgggtctgtttcacagcataaactgctctgaaacttgagaagtccccagaaccaggcatatgctgtggaatctgaggagaacagcacttgtcataaaaagatagctaatttgaaatagcttctaattaaaatccagtgttcaaacattaacaccaggaacacagtggaaaagcaatattagcaagccata

SEQ ID NO: 108535 - DNA, 352 bp, Homo sapiens
aatttttcgtagagatgagggtcactatgttgcccaggctggtctcacactcctggcctcaagcagtcctcctgcttcagcctcccaaagcactgggattacaggcacaagccactgtacccagcccagttctttaaatatcctcctcacctgccttatagtcttgttaacagcagtaaacccagtgcctggcacatgacgggcactgaatgtctggtgaatggagagtaaatgacaagcaaagcctcccccatcaaccttaaaatagccccttgtccatgcaccataactaaatggcaatctaatccagcttgccaaataatctttctttctttcactgatggggtaccgg

SEQ ID NO: 108536 - DNA, 662 bp, Homo sapiens
taaggacatcctgatggccggacagtcacacagccacacctggctgcacatcatctcctgggcgtcttcctcctcagggactttctgcactgttttctaagcctctctcttgagggccacatgagcacagagccctgtaccacctggactgcctttccacccatccgtaagaattcagctcccctgggtgaaccaaggaggcacccccaccccccatgccacactttgctagaggtaggcagagcagaagcagcgtcatgaggccagcaggcaccagctggcagtcctgtccagacccaggtgcctccgtctgccagagggggcagggcagggagatgggcctcagccctgctgctcccttcctgccaaggggctgggctgaggctggatctcagctgacccagctccaagcccagcccatgcttgagggggtgagtagccttggcctctctggtgttgcttcctcatctctccagctgggacacgcccaggctgtcaggtcactggtgaggggctccctgggggttgggtcagcctcacctgtccatccgggtgtcctgccaaaggtcccatcagctgcaggctctgcctgccctgtgtgtgtcctgaggcaagaggggggctcttctggaaggggtgtgggcagcacagccttcccagga

SEQ ID NO: 108537 - DNA, 284 bp, Homo sapiens
aacttacaatcttccttcacccaactatcaccagacacctgcaagttagctcactgcaaccttggtgttttatcagaactccacgtagcattctgcagcctaagaaccatcctataaaatccccggcaagactttgtctcctggcagtcagctcccatttagttacttgctctaataaatctgcccttcttcacctacaactgtcttgggaaattcttttctctgcacgccactggcccagtggtcgctcacccccaacaatatttgacagtgcagatctagag

SEQ ID NO: 108538 - DNA, 832 bp, Homo sapiens
ggctcttgcacaactttaaaccttcgtaaatattactatttcttcatctggaaaatttcctgtccttcaagagttacatcaaatgtcacttccttcaacaagacttttctaatttctccatagaattagattcccctattcatcctccaagctcccaaaactctctgttcatatttctataaagataacttaaacacactatattatcaggcatttgattccatgactgtgagaaacccgagagtagccatatccttctttaaatctctattatcaggacctggtgtgtattggatgtgcaataaatgctttgaaatgaattagttaatgaattatggaaattgaatttggagacaccaaaaactatgattttgaagtctgtgcaggaacattaaaaatggcgtatgatataatgaagtacaaagggaactgtaaaattaaatttacattctaatcaccaaatatgtaatattatgtctatctatgggtatataattatacttgtataatcgctccctgttagacatgtctcttttgagtatacttcatttatttgaaatagaaaaaaatgtgaaaatacagaaaaccagtcgacttattaaggcagtaggattgctttctttttctttttttttttgttaaaatgttgtttgtacaacacccattcatggtgaaaactctcagcaaactaggaatggagagaaacttcctcaatttgataaagaacatctacaaaatacctataaccaacatcatacttaacagtgagaaattagacacttttcccctaagactgggaacaaggtaaggatgtcctctctcaccactccta

SEQ ID NO: 108539 - DNA, 880 bp, Homo sapiens
gaacactctaatatactgtagtcccccattcattcaaggtcctgtgtagtcctttctggtctggagctatagtaaaaggaggcagtgagtgggccagattcaaacagggaatgatgccagtagcgagaaagtgaagaggcttttctggcgcacctgtacaggttgtgctctgcattccttgggggccagccccatggagattcctcctgtgcacagtggaggttgatggggatgctcatctcctaagcggcaacagtgtcctatgcactcataattcagggtcaggggatctcaggtcataggacaaatcacaggctgctgtctctgttcagggtacctcaagccatcaatggccacgttgagcaggtgaacacttcccctctgaactctctagctctctttgaagtttgggagggcatttgagcactcttctcagctaagcccaacatacggcctggaagtagattggacaagtcaccatttactataccttctctctcaaggtgagtttttttagtctaatgaaattgccacctttgagaaggttgctctgtactctagggtgcgcaaaaggaaattgtttgtcttccggaagtctttctgtaatttagaatggacttggcagcgattttatttttaccttccctgtcatttgtgaggctggcagtccagaggtagggtgtggaatggagccgtaaattgcgcttgcagtgaccagaaggggcccattttaactctaattgtgcctttcccggttcacttctccttttacccgccctctcctttttttttttttttctaatccacatttgagtggggaggaagaattgaggggggtgcaggtgggagtaggtttatttattggcgcttctctgggtgg

SEQ ID NO: 108540 - DNA, 313 bp, Homo sapiens
actgagactgaatctgtatttgttaggtttttttttttttttttttttttttttgaggcagagtcacgctctgtcacccaggctggagtgcatcaactatttgaactaaaagaatgactgaagcatagaaaggagaataagcaaaaaagatgtttagacattgcataaatatggaatttgatttatttgtatacacttatgaagtacaagtgcaatcttgttacatgcatggattgcacagtcgtcaagtcagagcttttagggtatccatcacccgaataacatacatcatacccattaagtaatttttctc

SEQ ID NO: 108541 - DNA, 157 bp, Homo sapiens
cctgaaattctgtgacctgctttgatgctgtgcactgactgggccttcaaccatgcccttcagccctactgttttcttgtactgtttatgatttcttctccgttctcactttctgaacctcttagtttcatcaaagatgacatctatatttctcatt

SEQ ID NO: 108542 - DNA, 128 bp, Homo sapiens
gatgcatggacatcttcctagatgttagcactgggttgggcctgaagggacctgccccatgcccttgcagggggaaaggcatccacacaggaaagaaagggcagtggtgaagtgcatgaggaagaggt

SEQ ID NO: 108543 - DNA, 356 bp, Homo sapiens
ctgtggggacagccgtggccacacatgcttcaggaaaaccaaaaagtcagatgactgcttgccccgaaagagctgtgggtccagttgggcacaaagagtaaacatgcatagagcgaggagctgtctttgctcagcggctttgaggagagtagcagcattgtgaagaccgcgttcttcgcatacattcctccatgcatccattctacacatttttactaagcacctcctagatgaagacgttgctgaaaaatagtctaagtttattctttgaggtcataaaaatgccattcgttgtagcagagctgaggagagatagctggtcaggaatccgggagatggagtgggtggacctgggg

SEQ ID NO: 108544 - DNA, 780 bp, Homo sapiens
ttaaataaactttgatgtttgaaatatttctgcttcttagtcaagaaagggaaaatgcaattggatgctaataaaataattacaagtaccaactatctagggtaaacaaagaaaaacaatgttacacaaatacatgaagaacacgcagaaaaacaacatgatagaaattaactttccgccacatttccatgcattgttttgaggtttatgtaatttacgacacaaacctcttattagattttgaattggaagaaataaacttgcatttcattatattatgctgtaattcagggcctaataagggcctaataaatcttaagtattgcattatactatgttaatgattgtcatcatagcttttccaacacaggcaccacagtgtcatcacagattataatttaaaggaaatattagcaattcagagtgcccatatactgtagttaataaagcagtgaatagaaatcagctttatagataatttaccagctaacgacaattatttttatattgtatcacaggcttatgtgagaataacttttaatataaataagatcgatgctcataacattgtaacttgtatactgtagcaactcatccaatactgatgactgatagtttctcttaataaattattgcctgacaacacacacaaaaaaagccatgatatttcatactgctcacttcccagaggaatttagcaagttttccaactacaacaaggagtcaaaattgtactggtaagaaataaagtgatggaacatgatttgccatatattgtgg

SEQ ID NO: 108545 - DNA, 394 bp, Homo sapiens
cttttgagcatttgtcacttccaaatgaaaaaaaaaaaaagtatctaattttttccagttctttctggtaataaattcatcttccctttaatagggctctattaaagttttaataacagaattgtcttttgttagtaatgagtagaatggatgatctattcatttgcttatttacccatccacactagaagtagagcactaagaggtacaaagacatggtaggtttttgcctctgtgagctcttaatctggtggaaggtataagaaaacagacttttgccgggcgtggtggctcacgcctgtaatcccagcactttgggaggccgaggcggatggatcacttgaggtcaggagtttgagaccagcctggccaacatggtgaaactccatctcta

SEQ ID NO: 108546 - DNA, 1933 bp, Homo sapiens
gtccctgggtgtgcatagggtctacacccagcaggatttgctgtatcagaacgactgcgtcttcttgcattgcaattctcaacgaacaaaactaccaccttatccatgactttactataaagcagatgaggcagggagcattccttgtgaacgcagcccgtggtggcctggtggacgagaaagcctgagcacacatcctcaaggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggtccgtaataaaccagcaagaaattcatcctgagctcagtggtgctacctacagatatctgccaggcatggtgggcgtggctccaggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcagagaatgccggaaggtaattattcagatatacttgggaacagtgaaaaatagataatctaagagaaaaagaatctgacggcctttttagctgattccggacatatgcatcattgttgttgcagtgttaaaacaagagctagaaaactgacaatgtcgtctgcttacggaagctctgaaagactagggtgtgatttattaacgaccaacttctattattgtgtgttaagtttttcatctgtgcatcaaatcacaaagaataaatagaacttttccctttatcagtcccttaggcacagcaggtcctgaacaccctgcttatatgttgcatcagcagttcaaatatcaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgcaaaaaaaaaaaaaaaagtattaagtttcacaagttgttagtaatcaagtatattttctcagtttcagatcctctgcgattttattgagtggaaagtcttgcgctgaaagggttcaagaaaaataatattgcatttccttatgtcacaggaaacacttttaatggtaacttgtcagactatgaacaaacccactttttaagatattgataaagtcttcttttcttcacgtgatattttatacaagtacacttcagatgtattggatgtggctgattttaacaaatcctattagatttgtatcaattagttacatgttctattcatagtcttttgtgaatcattgcctttttgtttaaaaagatggcctattttgagcctttgtataagtacattcctgtttttgtgacaaaagaaaaactttaaatttgtcccaaagagaaaaataatggctatcagaagtatgctttgttttagtgcgagttaccgttactgtatttgtgtattgtaaaggtggacattctaattacattaaaatgtaattagaaaaaagtgcttaatgaacaaaaacagaacatagacaacaaaagaatattagaagtgatgcatgaagaaaacgagatatcaataaaaagatttttaaaaaccaag

SEQ ID NO: 108547 - DNA, 134 bp, Homo sapiens
ctggtgctaccagcctcaaaaggtaactcttacgcctgaggatggacaccttttagaattaaaagaactctcagtcattgtgggacatcttgctagccttcatagagactgatttactgtcagctcttttcttg

SEQ ID NO: 108548 - DNA, 401 bp, Homo sapiens
tgcttttacaggatcccatgtgccagaaaccctgaaagatgggcagaaaaaggcataacctccaggctgccccacagctcccgtagagcacggtcaagtccaacatgatgatcaccacgcccatttctcgaaaacggaaattgaagttggagcctggagcacagttcttgggaactaccaagactagctgggagtctcctagttctgggactatatgggacatctgtctcatgactaccctggctggcacacctccctgtcccctaatacgcaatatttccaagtggcctggagagagcaggaggatgaaaaagaccactgggtggtccctgcaagccacacacaaccatttcaacccttaaggctaagagccaacagtgttatctgcacaagcctgtcaa

SEQ ID NO: 108549 - DNA, 231 bp, Homo sapiens
atattcctaacacagaaaagatgtttcaaatgatgggtatcccaatcaccctgatttgatcactacatattatacacaggtatcaaaatatcacatgtacccaaaaaacacatatcactaaataaaacaaaaactcaatttaaccatacaactgccaagagacaccccccacctttcccaaaccccttctttatcctctacccaataccctaccctcctaccctcctaccc

SEQ ID NO: 108550 - DNA, 359 bp, Homo sapiens
cagtacagacagtcccaaacttacgctgtttcaatttgtgatgcgtttgtcagaacgtaattccattgtaagttaggagcatctgtatatatccagaagactaaaatattctatcagcgtagaaagtatattctatggatgaaatcatacaaaatgaaataactaaaaacatgagactttttttatgacacacatcacagttttttgtttggcacttctatgaagctagcatattaaatgaaagcactgaatggtgaaggcctaaacatagaatctgttcctgggaaaccatgtgctcatctagggtgggttttgtgaatttgagcaagtcactaagggcaggtaagcaagtacccttg

SEQ ID NO: 108551 - DNA, 246 bp, Homo sapiens
tttgagaccagtctggctaacatggcgaaaccccgtctctactaaaaaaatacaaaaatcagctggatgggatggtgcgcacctgtaatcctagctacttgggaggctgaggcacgagaatcacttgaactccggaggtggaggttgcagtcagccaagatcgcaccactccagccatggtgactcccagaattgtctgcctggacagtgtccagagcactggttccaccttagccgctgccagag

SEQ ID NO: 108552 - DNA, 861 bp, Homo sapiens
ggatctcaaggatgcaagataaagagaggcagtatgctgggggaatttggtagactggaagcaggggacagcggtctagacttaggacaaaatgaatgagagatgcttagggataatgggaaaaaaattaattcaatacgtttttggcagctgcttttcctccccagccacttgaaaaagccaagagactctgacagtcgcaatgcttcagtccaacagagtttgtcagagtcattagggaaacggacatagcagaatttttgggtgggagatgatggtgcagggaaagttgggtaaaacttcacgtgatatttacatgctccgcagttttggaaagaagaggacagatctctcctttgacaagcatcaggatagatcagcgaatagagtggatagtggaagataagtctggaaaagtaatttagagacacattaaagaggcttaaggaattgggctttgattcagtgctgtgaaatatgttcattctaaagatatttacatgcagatttttaatgtgatcagctcttaatttgtcctgtaaacttggatatttagttcatgttttcttacaatgaatcactctggtatccacatatcagcatagatgctactgtatgtggtttctcttctgttgatgacaagttgcctcccctgtcagctcaaaaggaattttctactaataaatcttttacagatgagtaagcatgccaagagagattaatctgggtctgagtagtattaagtcaggattattaaagagcctgtaggagggtccaactctttcactaaggtttgccaagaatggtccaaaatggtaagaaacatatctctcattctggaaccatttttgatttaacggg

SEQ ID NO: 108553 - DNA, 568 bp, Homo sapiens
aagacattcaaatttacacatagtagtaacatcatcaaagccagatgtcagaaagaaattttgaaatcagcaagagaaaaaacaaaataaaaaacatcacatttaactgatcttcaataagataatcagctgacttcttatcataaatcagagaccagaaaacaatgggaaataattttttttcttttttctttttcttttcttttcttttttttttttcggggatggagtctcactcagccgcccaggctggagtgcagcggcgctatctcggctcaccacagccatcatctcccgggttcaagcgattctcccatctcagcctcctgagtagctgggattagaggcacctgccatcatgcccagctaatttttatattttagtagaaacagggtttcaccatattggccaggctggtcttgaactcctgacctcagatgatccgcctgcctcggcctcccaaagtgctaggattacaggtgtgagccactgtgcccggccaacaatgggaaatattttcaaactgctaaagtaaaaagaatgccaactgcaaattctgtatctagc

SEQ ID NO: 108554 - DNA, 697 bp, Homo sapiens
ctgttcctgtcccatcccggtaccctctgccacctccagctacctgcttagcagtttcctctctgaactgccttctcaactgcgacgacgaggctgagcccctgcgtggctcccagatgcagcctagaaaggagctgtgatgggggctctggccctgccatacccgcctctgagtcctcacctctgcgtggtcactacactctgggggctttttttggtgtttttgttttagagacagggtctcgctttgttgtctaggctgagtgcagtggcggcatcatagctcactgtagcctggaactcccgggcttaagcagtccttccacctgggcctccagagtagctaagactgtacaggtgctcgccacgaagcctgggtaatttttttttttagacagagttttactccgttgcccaggctggagtgcagtggtgccatctcagttcactgcaacctcccactcccaggttcaagtaattctcctgtatcaacctcccaagtagctgggattacaggcgcccgccaccaagcctgcttaatttttttttttttttttgagacagagtcttcctctgtcgcgcaggctggagtgcagtggcgccatctcggctcagtgcaagctccgcctccctggttgacgccattctcccgcctcagcctccccagtagctgggactacaggcgcccgccaccacg

SEQ ID NO: 108555 - DNA, 472 bp, Homo sapiens
agctctattctgacctaggccttgtgataggttctggagatgcagtgatgccttagaaacatttcttatttttgagaaactcatggtgctgtgtaaaataaacaatgatagtatcctgtctgaacacagagaaggcatccttaacccgtcttaggatatcagggaagcttcctgaggaaaattacccctgcactgattatctagggatgactagacattatttggtgaataaagaaagtgcagttaaaattgtatgagataaggagaagtaggcgctacctgattttaactttttgtggtgctttttttttttcctatcgggctggcttctgtattataagagtttaatttcaaagcattaagactacacaacttctgtgtcactgattgcattgaatgtcttttgcaggcaaatgctttggctaagctggtttttgtttgttcttttttttttttttttttttttggccaa

SEQ ID NO: 108556 - DNA, 198 bp, Homo sapiens
agactgaggcgggaggatcatatgagcctgggaggtgaggcgggaggatcatgtgagtctgggaggctgaggctgtggtaaaccatggttgtgccacggcactccagcctgggtgacagaggaaaaccctaagggaaaaataaaataaaatgcactaactatattaactgcattttaaaaaagagtatagtgaaggaa

SEQ ID NO: 108557 - DNA, 366 bp, Homo sapiens
ctcccagagtgctgggattacaggcatgagccaccacgcctggcctataatgctactttcctagtgttaaaattagaatcagggaaagtacagatccaaaaaattcttatggcagggaatgaaaggtaggagcaaatattgaatcaactgaacaaattaaatctaggttaaggtaataatgactaccacaattaaagtgtcacaatgttttaaaaaataatatagcaagaggcctggtacggtggctcacgcctataatctcagcacttttgggaggcactccagcctgggagatagagcaagactgtgtctcagaaaaaaaaaaaaaaagaaaaaaaaagataatataacaagaaatactaattt

SEQ ID NO: 108558 - DNA, 390 bp, Homo sapiens
ctcccagagtgctgggattacaggcatgagccaccacgcctggcctataatgctactttcctagtgttaaaattagaatcagggaaagtacagatccaaaaaattcttatggcagggaatgaaaggtaggagcaaatattgaatcaactgaacaaattaaattgtggtagtcattattaccttaacctagatttaatttgttcagttgattcaatatttgctcctacctttccccccccccccccccaatcctttggatctgtactttccctgattctaatttgaacactaggaaagtagcattataggccaggcgtggtggctcatgcctgtaatcccagcactctgggaggccgaggaaggcaaatcacgaggtcaggagatcaagac

SEQ ID NO: 108559 - DNA, 302 bp, Homo sapiens
tatctaacaaattcctattgttttggaagataattgaaaatgcctaaatgtgtaagtacaaatacttaatcagtgttgtatgagaggtgcatttaatgccctatgggaggtcaaaggaacaaaggaagaagagattaattaactcagactatgatggctggtagcagtagaggtggctgttagtggaagagaagaatttgaacacggtgtgatgcaagaaatgacaactccaggtgacggcaaaggcataagcagatgtgaataagtagtgggtttctaagtgaaaagagcccagcttaatt

SEQ ID NO: 108560 - DNA, 269 bp, Homo sapiens
gacaatgcagctgggatggtcagagacagaaccaaggcccaggccagacgcctgcacgagacctgctcttgctgggacctgctccgtgacaatgcagccggggatggtcagaaacagacccaaggcccatcttgctgggacccactccgcgacaatgcagctgggatggtcagagacagacccaaggcccaggccagatgcctgcacaagacttgctctgtgacaatgccgctggggacagtcagagacagacccaaggcccatcttgc

SEQ ID NO: 108561 - DNA, 557 bp, Homo sapiens
aagcttcttctttataagtaagttacaagcatctatttgattacatagttaattgtacctgaaaattatttatataatgaaatgtgaagtattttttattataaattgcttcttttagattatcttttatgtacatttaggatattcatgttttaaagctgcatgtacagtagttaatattatcaacaaatttgattttagagtagtaaatgggacatgacagaatttttttgtcatataaagagagctatgagaataatggatagggttttgaaccaatgaaccaatccctgcctcagcgtttaaggaaggagggtatgcaaattacccagataggagggatgcttatcttcttcatgaagttccccagggaagatttcacgtgtacctcattaatttgtattagtattttgaaatcttcatagtaagctagttcttctgtattaatattttctaggagtcttcatatgtcactctaaaaacatgaccgggccaggtgcagtggctcatgcctgtaatccgagaactttgggaggccgaggcaggtggatcactga

SEQ ID NO: 108562 - DNA, 405 bp, Homo sapiens
acaaagctgaagacatcacactaccagacttcaaaatatactacaatgctgtagtcacccaaaccgcatgatactggcataaaaacagacacagaggccagtggaacagaatagagaacctataaattaattcacatatctatagccaactgacttttgacaaaggcctcaagaacatctactgaggaaaggacaatcttttcaataaatggggctgtaaaaactgaatatctatatgcagaagaatggaactagactctcacctcttaccctttataaaaatctaattataatggtttaaagacctaaaactcagatatggaactagaagaaaacataagggaaacacttccagacattggtcttagaaaacattttatgaataagacttcaaaaggagtcaag

SEQ ID NO: 108563 - DNA, 316 bp, Homo sapiens
gctcaccgtgtgccgtgctccaggaagtaactccccctaggattccagacaaagggacagttcaaaagcttgtcaacagcattgcaataaggtcaggactaggtagcaatctgtttgcaagtcaggtgatgtccaattgtttgcttcccccataacggaaggagaatttaattggggtatcagctgacacattagtaaccattttatcagcaggttattgtcatttcttagcgctaactcagaaggactttgaagaatcgagtgacatttctacaatgaagccctttccattcccatctatttattaatgtgaaca

SEQ ID NO: 108564 - DNA, 833 bp, Homo sapiens
gtggcgccgctgcagtccctgtctgctgtgaccagctctgaccaaaggaggcgtagtaaggaagccaggacacctggaacccgggatacggactcagtggtctttgaggatgtggctgtgaacttcacccaggaggagtgggcttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaaggtagtcagtttggagaaaccatcagtcagactccaaatcctaaaccaaacaagaaaacttttactagagtaaaaccatatgaatgtaaaaaaaaaaaaaaaaaaaaaaaaaaaaaaaaaaaaaaaaaaaaaaaaaaaaacaaaaaaaaagagaggggggggcgcgcgcccaaaagattccccccgggggggcgccaactcaagggccaaccacggatttttggaaaaaagagggggccccacttatgaggagggagtcattattatatatatcagagacgaggagagagaggaggcgcgagcgtgtttataaagaagaggtcgtgggagagtggggaaaaacacgagggagaccaagggaggggaacacactgttggagagagggagggcccacctctaatagctcgggggaggggggacgaaacacactgcgggggaacaacaaaaactcaccgaaacgaggagtaatagaggcgcccaccggaggggggcaaatatccaacagtgcggagcgcgacaaa

SEQ ID NO: 108565 - DNA, 606 bp, Homo sapiens
accagccgctgcgctccgctctggggtctcctcaccccagaaggccctcaggtggaggaagggcctcaggtggaggtaggacctgtgctggccgcgggagaggtaaacagaacaccaggacatcccagagtctgggaaatggactcagtggtctttgaggatgtggctgtgaacttcacccaaatacattttctttgtggatctgcatgacttatggtaccctcctcatctgggctgtgaatatatatgactaataaactgttgtcagttgcatttgtccagtgatggatatcatgtgttagcctacctaaatagccctagggccctaattcctctctcaccaatggggtgagtgggaggctattgaaacatgcacatccatgataccccatggtcaggcactgatgagcaaagaaaagaaggtacatttggtatcaatcctttccaaagcatgagaggatgtaactcaactgttcttccaaagcaaaacaagtagccagggggctacattgttttctgtagtactgctgcttaccagcatgtcaaagggataatcttgagatcacaaggccgttggttcccaccagggtcttaggcaaaattacc

SEQ ID NO: 108566 - DNA, 509 bp, Homo sapiens
accagccgctgcgctccgctctggggtctcctcaccccagaaggccctcaggtggaggaagggcctcaggtggaggtaggacctgtgctggccgcgggagaggtaaacagaacaccaggacatcccagagtctgggaaatggactcagtggtctttgaggatgtggctgtgaacttcacccaggaggagtgggcttgctgggtccctctcagaagaaactctacagagatgtgatgcaagaaacctttgttaacttggcctctataggggaaaactgggaggagaagaacattgaagatcacaaaaatcaggggagaaagctaagaagtcatatggtagagaggctctgtgaaaggaaagaagagatggggttttgccatgttgcccagactggtctcaaactcctgagctcaagtgatccacctgcttcagcctcccaaaatactgggattataggcgtgagccaccatgcccagccaaaaactttaaacttagaagaacattgcaag

SEQ ID NO: 108567 - DNA, 437 bp, Homo sapiens
ggagtgaaatgtgaaagaaaaactataaagttaactgaataaaatgtaggatgaactttctgatttagagacaaggaagaagtttttaaaacttctaaagtacaaaccatacagaaaaacaaataaaaatttgattacatcaaaattatttctacccatgaaagacatcacatatacaaatttgctaggtaacaggagaatcgaagaaggtatttgcattgtcaaatatctaaagtatatgagggccaggtgccgtggctcacacctgtaatcccaacactttaggaggccgaggcaagcggatcacttgaggtcaagagttcgagaccagcctggccaacatggtgaaacccctgtctctacaataaaagtaaaccaacttagctgggcataacggcctgtgcctgtagtcccagctactcaagaggtggagatgg

SEQ ID NO: 108568 - DNA, 431 bp, Homo sapiens
ttgagatggagtctcactgttgtcgcccaggctggagcgcaatggcacgatctcagcttactgcaacctccacctcccgggttcaagcaattctcctgcctcaaccccccaagtagctgggattacaggtgcataccaccacgcccggctaactttttggatttttagtagagacagggtttcaccatgttagccaggctggtcttgaactcctgacctcaggtgatccgcccgcctcggcctcccaaagtgctggggttacaggtgtgagccaccgtgcctggctaacatactctttctaaatatctatctagcaacatgcattatgattagaaatattaattccctttgatccaggcattctgtttttagcagaataggcacaaccgtttgcataaaagacttagagtagttttattcatattaattaa

SEQ ID NO: 108569 - DNA, 451 bp, Homo sapiens
gggcaacacagcgagacccccatctctacaaaaaatatttaaaaactagctgggcgtggtggcacatgtctgtagtctcagctactcaggaggctgaggactgcttgagcccgagaggtccaggctgcagtgagccatgatcgcaccactgcactccagcctggtgacagagcaagatcctgtctcaaaaaaagtaaataaataaaataaataaataaatcagctaattaaatcagggagatgccctccacctttccataagggtgggtaggtgattagagccttagcatccacatttcttcatctacaaaacagggcaaataccatcaacccaaggtgggggtggggggaggggcagtgaagactgagatgatacatttgacaaaaatgctatacaaatgttaattaattaattaaatgcaaagttcctcctggcccccaagggtagtat

SEQ ID NO: 108570 - DNA, 451 bp, Homo sapiens
atttttctaatagtcatcgtgagcatcttttcatgtttttttggtcatttgtataacttctttggaaaatgtctgtggaagttctttgctcatttttgagttgggttgtttttgtcaggtgttcgtcccacctcatcctcctgagtacccaggactacaggcacatgccactatgccccactaatagaatctattttagacctaattatattctgtctacctgaaagacaattgaaataaaatgacataaagagaaagataaaacatgccaacactaatcaaattaagctggagtggctatgttaatatcagacaaagcacacttcaaaacaaaacactgggccgggaggctaatgcctgtaatcccagccctatgggaagccaaggtgggaggatcgcttgagaccaggaattcaagacctgcctgagcaatatagcgagactccatctc

SEQ ID NO: 108571 - DNA, 334 bp, Homo sapiens
ttcctgggttcacgccattctcctgcctcaacctcccgagcagctgggactacaggcgcctgccaccacgcccagcttatttttgtatttttagtagaggcggggtttcaccatgtttaactgcttattttcttatctcaataatccattagaccaaactgaataaaggaacactgccctatttatttcctttatagtagttactgctatttaataacaatacttttctcttctcccaaaacgaaattctattaggctggtgcaaaatagctcctcgaaaaaaaatcagcttaaaacactcctacaaatcctgcaggagaaatatactaatgga

SEQ ID NO: 108572 - DNA, 498 bp, Homo sapiens
gggcttgtggagagaaaagaggagctcgctgccagggaggcacagaatgctgggctgtttggtaccccttctaactcctgaccgcttcttggaatcccagggctttctgagcagggccctgaaacatgctttcttgtaggaaactagggcagagggccaatttgacgaactgactttaaaaaattgttgattcaagagtagcaacttggctgggtgtggcggcttatgcctgtaatcccagcactttgggaggccgaggctggtggatcacttgagctcaggagttcaagaccagcctggccaacatgatgaaaccccgtctctaataaaaatacaaaaattggcggggtgtggtggcacacacctgtggtcccagctacttgggaggctgaggcaggagaatcacttgatcccaggaggctaaggttacagtgagccaagatcacaccactgcactccagctgggatgacaaggttactgagactccatctaaaaaa

SEQ ID NO: 108573 - DNA, 257 bp, Homo sapiens
aaacaatccacccgcctcagcctcctgagtagataggactacgggtacaggaaaccacactgggctaatttttattttttgttgagacagggtctcagtacgttgcccaggctagtctcgaactcctggcatcaagtgatccttccacctcggcctcccaaaatgctgagagtaccagtgtgagccaccgttcctggcctgaaaatgtttaaatatcaaattgagacaagggtctataggccagagttgatgataaa

SEQ ID NO: 108574 - DNA, 404 bp, Homo sapiens
atgttcacagtaaaattattttgtaagggcaaaaaactagtaaccaactaaatgcccatcaacagtacctgaaatgtaaattctgtatatccatacaaaggaataaataaatgaactatatttgcatgcagcaaaacagacaaatctaaataagggttaaagaacaataaaaaaaaaacagactcaaaagaatacatactatgattccacatatttaaaagtcaaaaccaagcataccaaacctatagttattagaagtcaggagtatactttagggaggaagcagcgatggagccacaaggaagggtttacagtactgaccatggtctctatctgaacgtgtatagtggcttctcaatgattaaccctgatagttcattagcagtatatttattgtactgctc

SEQ ID NO: 108575 - DNA, 414 bp, Homo sapiens
gagccggacttcctctccgcgccccccgactccgagctcctcttaatggagatgcggtgcggaaagttcaatgaaaagccttggctctaaccctgtggacacaccttccgtatctgctttcatcctgccttacccacctgcgagttcaccaccggacgggggaccctttcagtcacctgtttgcagcgtttaatgaagataacttgtttcttgaaactgctctccaaggggtattactcttttctggttctcttcctgcctttcttctctatcccatctctgataatggttccagtatctgtcctgctatccgaactagaaaaccaggaatcatcattggttcttcatttccacttaacactgcactgtattattttttttttcgccagaattagtgcggttgccccctctgcc

SEQ ID NO: 108576 - DNA, 392 bp, Homo sapiens
attatttattttattcaacacctctaataatctctattattatattaaacatttactctgtattaagtatagtattaaatgttctatatacattatctgttttattcactcaagacaattctatgatgtaagtactactattttccacattttgtatatgagaaaatgttatatcgatagcttgaagggtttgaagaacttgtctaagttgacacccaggtggggaactgtgatctgatcctaggtcatctgaatccagaatcagctttctgccaccattatcaagggacattggatattctgtagcatttactaaaatcaagaaagttaaaaaaatataaacatgagagatctatgatgcccatcttgaggagttcacaatccagttgata

SEQ ID NO: 108577 - DNA, 316 bp, Homo sapiens
gattcccgtaggccacttcctttagatggagccatgttcttgggcaagtaactgggaaatagagaaacagagccagacccagaaattggatcattgtagaagttgattgaaatgcattgcttgattgcctgagccttggtctcagtgaaagagtgacagagccactcatcccaacaaaaggaccctgacgcccagtgtggtgctgtatggacaaaggcccaaagtcagggcggactaagaaaatctagttactaaccattgccttgcatctgaaatctacagcttgcaatctagttgtcaaattgttgttagcatt

SEQ ID NO: 108578 - DNA, 428 bp, Homo sapiens
taaagaatgctgaatataggttgaatctctcctggcttgtagggtttctgctgttttaagccttattgggggtttcctttataggtgatctggcccttttctctagctgccttagcttttttttcctttcattttgaccttagagaatctcatgtgtcttgggatggtcatcttgtatagcatttcacaggggttctctgcatttcctgactctgaatgttggcctctctggcaagcttggggaaattttcacggatgatattctgaaatacactttcgaggttgcttgctttctctcccttacagggacaccagtgagtcgtagatttggttccctttacatagtcccatattttacataggttctgttcattctttattgttttttcttcatttctgaatgagttatttcaaagagccagtctttg

SEQ ID NO: 108579 - DNA, 795 bp, Homo sapiens
gtggagcatccctgcaggggactctggccagcctgagtgacgtgatccaaagagcactcctgggtagaaaattgcctgggtggaacgcctcaccagaacagcacgtagcaggcccccgtggaggattaacacagtggctgaacaccgggaaggaactggcacttggagtccggacatctgaaacttggtaagactcgtctttggaacttgccctactccatctgagtggaagcgtggcctgatcacccacggtgtgcctgtattggcacttttgttctggttttgacttgacttgacttggtaagactagtctttggaacttgccccactccatctgagtggaagtgtggcctgatcacccacgacgtgcctgcattggcacttttgttctaaacaagaaaatatggacaggatacttatctaaataaaattactaaatattttgatactttattccagtaaatatggatgcttagataaaagggatcatacacaacagcaacataatctttccaaaatcactaaaagaaaataaaaagttttataatcatgttttaaatggcataaagaagtaaattttccatgttcatagactgaaagtgctaaatctagtaaagatgttgtttctaaatgtattcataaagttaatgcactgcaataacataatatttgccaaaattatatttattctaaaatatatgtagaagagaatacagtaatgagaatcaattatgtgatacatgagatggaaggatgggatgatatgccataccagctattaagatctactatatc

SEQ ID NO: 108580 - DNA, 436 bp, Homo sapiens
gatcctcccacctcaggctcccaaagtgactgggcccacaggcatgcaccaccatgcctggctatttttcattttctttagttcagatgggggtcccactgtattgcccaggctggtctcgaactcctggcctcaagtgatcctcccaccttggcctcccaaagtgcttggatacaggcatgagccaccttgcctggcctagtttcttaactttgatataattaaatgtattaatattttcctttgtgatttatattttgtctatcttgtttaagaagtccttccctggctgagtgcagtgaacccaggagacggaggatgcagtgagacaagattgtgccactgcactccagccagggtgacagagtcagattctgtctcaaaaaaaaaaaaaaaaaaaaaagtccttccctaccctgaaattataaaaaaaatt

SEQ ID NO: 108581 - DNA, 345 bp, Homo sapiens
acaagccatcatcactcaaatccactttgcaagcagtctggcagttctgttgtgatagaattttgacctgcttttctgtgggcaagctgatattcttacagacaatattgataagaagttgccagtttttctctgtctgatgctttttgtcgtggtattgggcagtacaaacctcttacttggccttgagtcttatttgttttgaggttgcgggtagtaatgtgatttcagagaattagctagaatttctagattggaggttctaccatccatacaattgcctgaagaagccaacagctgggcctgaagtgatctgtagcgctgatctccttctttaccccaagt

SEQ ID NO: 108582 - DNA, 410 bp, Homo sapiens
taacatttttgtagatgttgtgaaaaacatttcttgtaaatcaatatctagtttagtaatgtgtcaatatcacctctttaacaaggtcttgttgaaatgttccagcaaggtccagctatgttccagggggtcagagaagtgtgcccctaacatggttgtggggaacagagcatttcctctgaggaaggagcttctaggactagaaatgaagggccttgggaatctccctaagccatcagcttacagtggagcggagcggacagaattctttctatgctctttggtgatttcaggatggagcatggaataggagctgctcatgatatgtttaggtggagtcaggggtcctgggtttcagtccctcctctgactcttaacagaacgtaatcttgagcaggtcatttgacctt

SEQ ID NO: 108583 - DNA, 237 bp, Homo sapiens
attattcatagattgtgctgtagtttgttgaggataaaatgagttaatatatgtaaactgtttagaataatgcctgatacctgttattaatatctactgcttggaagtcagaaaaaaaaatcctatcacaaaggcaacagacactataaaattctttggaataaattttgcaagcatgctatgtgacctaatgtgagggtacctataaaatattatttaaaaaacgtaaaacaggac

SEQ ID NO: 108584 - DNA, 461 bp, Homo sapiens
ccaacttctcctcactgagtgggaccctggacctcggactctagcacaaccactctggccccacctcaacactttagtcggaggcggttctacatttcactgaggaggaaatcacagagacaacccacagcccgtctgccactggaactgcagtagtaccaccctaaccaccctcaggatggggaaggaacaaaggacctggttgctatgctggcatttcccacacacaacagccaccatgcagagaggagcccagtctctcttccctgcaagccctcaatccccactcttcaccagactgagcccccggcttgggaccacagaacagccatcccatgcatggctgagtatatccacaggtagaggctctatgtttccctggaaaagggatcttagagtgaccaacagcccctctgccactgccacgacagtggttctgccactgctgccctcagtctgag

SEQ ID NO: 108585 - DNA, 468 bp, Homo sapiens
tgtacagaaagctttaatgtctccccatgacctttatggcaaaaaccaaattccctcgaccagtctttggattactacacaatacattgtcaaagaaaatagcctggaatggtgaacagagcctgaggctcagttgggagtcctgacttctcatcagctgtgcatgagcaaatttggaggtgttccttaacttgtaaaatcgatttggatttttggtattttaagcatgatttcctttagttctttttttttttttccagagtgctagaattcagtcttttagttctttgaacatatttataatagctgctttgctgtcttgtctactaagtctgacatctgggccttcaaggacaatttctgctgcctgcttttcccttctttctgtgtgtcatacttttctgtttatttgcatgcctcatgattttgtgttgtaaactgggcattttagatagtattttgtagcaa

SEQ ID NO: 108586 - DNA, 541 bp, Homo sapiens
ggggcgtggcacagggtagacgttccataaacatttgagcaaattacagaacttgtaaaggactcagtcccactttctttttcctgcaaagactaggggcaattgcttctgttaaaatggcctctttgtagctacagatagcatgttgagtcagtatttagaaaatgaatgtgcctgtctgtacttctgcatttgtaagcataaaaacacacaggtgggcactgcccagcaagtggttaggaccacgggcactgtatcactgacatattcttcttcttttgtcgtcttcttcttcctcttcttcttcttcttttctccttctccttctccttctccttctccttcttcttcttcttgagatggagtttcgctcttgttgctcaggctggagtgcaatggcacgatatcggctcactgcaacctctgcctcctgggttcaagtgattctccttcttcagcctcccgagtagctgggattacaggtgcccgccaccatgcccagctaatttttttgtatttttagtagagacggggtttcacc

SEQ ID NO: 108587 - DNA, 340 bp, Homo sapiens
ctctacaggagcccccttccaggcccaccagctaccccccagattgctgtatacgcagttgtttcccttgaccaagaattgagagccatttcctcctcccaaaaagcagaactcatagctctcaccagggccctaaatctttccaaggcagggagacagccgtttaggaggcccaacgagagaagcccctaaggagggcatgaggttagtccactatataaaggcctccaaaactgaggtggtctcataaatgaaaccctgggtccatttgacatccatcctgacttccaggtagcctgttcttgaccagcaccttccttgtgctttagtatatctcatg

SEQ ID NO: 108588 - DNA, 349 bp, Homo sapiens
cataaaataaatgttacatgaaaatgaattgtataggctgactacatgcattaatacttatacatgataaggaccagccaacgcttacctaaaaatttagctctcaggtggtcctttgattttcagttcggggccacgcaaagcaaatcctcccataccctaaatacacctcatgtggcatcaaacaagaaagtatatgtccaggtttaaggatcaggattttttaaactatctgttttttttaaatgagggcttaaaaaccttggacttctctcttcccagaaattgagcaacattattaattgatgactatttctgtttaaattaaatttcaaatgcagagtcatta

SEQ ID NO: 108589 - DNA, 665 bp, Homo sapiens
catcatcccttgctgcaacaagcaaaccaaacttggttcaactctaggggtttcctggtggtctttggccagaaaatattctataaatgagctaattactcagttgtgtccattctgggaaacaaatctgaattctactagttaggcccacctccttaacactaggcctggcatgttcttaaagcaactctgtccctctctgtgacttcagttcttctgggagatttattattaatgggctcatatgatgaaaagattttagtcttttggacagaaggagtaactttcttcttagaatccaaactaaaaatggatctttcatttataaatgataatagctaacagctaatactatatatcaggcaccgagctaagtattttacataaattgttttaatccttgtaacaagcctatgaaatggatattattaccacctccactttacatacaaggaaacaaatacagagaggtgaattaaattggccaagattatacagctaatggtaaagttagggctcaaattcaagttgttctaacactacatcctttgctttttttgctgtgagattttttttttcttagacacctaggttgcttccaaatcttggctattgtttgtttgtttgtttctgagatggagtctcgctctgtcacccaggctgga

SEQ ID NO: 108590 - DNA, 500 bp, Homo sapiens
cagagcttcctgtcctttccaatgaattccaggcttcccatggtgcttgcagggctctgccggaagctgctgggaaagctgacttccattctggttgctatgaactccatttttggttctgttctgtgaccatcttcatttcagtcacttgcaccattataaggattgaaaagactcttggcagaaaagcagttttttgtttcatagcattagggtttgatatataatattatttttgaacagaaaaatttcacataagagttcataaagggtggtattttagagctgaaggggcttagaagactgtctagttcaaccctgagatttttttcaggtgaggaactgaggcccaggcagaaagactggttttctccagccctcacacatgtcagtgagccagggttaaaatccccagaggtctgactcctattcatgtgctacttcccttaccccagggtcaaaagctcagatgctttcagagtccagataagtgaggagga

SEQ ID NO: 108591 - DNA, 1977 bp, Homo sapiens
ttttaagatggagttttcgctcttgttgcccaggctggagtgcagtggtgcaatcttggctcactgcaacctctgccccccgggttcaggcgattctctcctctcagtctctcaagtaactgggattacaggcacacaccaccacggccagctaattattttgtattttgagtcgagaggagaattcaccatattggcctcaggtaatccgcccgcctcggcctcccaaagtgttgggattatgggcgtgagccagccacggtgcccggcccgttttattgtttgaaaaacaagtacaggttgttattatccaagaattgttgatagagtatatactgtatttgaagtgtagaactgaggcagaggctgattaatataactagtttacatttgttagcctttcacatctgtgaaggaataaagtacagacaaaagtggaaaacaaaccagaaaaaaaaaaattgtgaagcacagagctgcttaaaagagtggtgtcacattaaaagaaaaaagtcacagaaataagtcagtattttgtttagagactagaactccaactgctagccaactgcctagaatatagtaaatattttctagtttcttaaatgactagtaatattcctacattatgtgatggcatttcccaaactgtttaattagatgttagatttgtagccaaatatgtctaggaaatgcttaaacaatataaaacagttttaatgattggctttttagaacgttatatattagtgtgctttatgcatatccaagaggtgagtgaggtatttggggtttttcagacttacttgattacagatctggagtatctcaaaacagttgttttgtggaaaacactttggcaaactctgagtcttagtcattaaaaatagtttttgggtaaacaacagtgtaatagaaatggaaattactgattcacattgagccatgaagaatttattttcagcgatttttatagaagttgctttatgacaaagaaagctttggttaactggcatttggcatttcacacccctaaattttctacatgaggatttatttctctggttctctcactttctcactcagttatactgaattcatttatgatgagcgctctcaaccattcttattcatcaaagctgaagttggcagagccctctctggtacctgattagaagtccgtcttccgtctcatagggaagtgttagagatggataatgtttctgtgtagcagaagtagtcattatgtccccttaaattcggtcactttgactgcagtagagcttcttagtgagcagtctgtgatggagtatactttcggagaagctcatggtgggggaaacctggaatttatctaaatatttcatttctttgataaattacattaaaaaattaataagagtatctatttggtgaaatcattttcctccacgtgaccaaatgagaaatttagtgaaagatttaaaatcatttttcagactttttccacattagttgggaagcaaaccccttttttaaggcaatgtcagttattaagctttagggaaccacatgccactttaggtaacacatgattggagagattgaagagtgaagtccctgctttaaagtgtactcctgtggacacagtaatacatatatttaaaatggttcatgttaagagtaggtatatttctatctaaatactctgtagcttttgtgattcagggaaatgagtggagcctcacaggcacaagaatctagtaaattctaggtttcttgtgtggaactcagtgggcaaaatcttaactgagtgaattcttgattattggtatcacatttattagtctgtatgtatctgtgtcatcgatctccttaagaagagactcgtagatattgactgggagacccaagctgaatgctaaaatctgctccatggatataagctgatgcagtcatcatttcacattaaaatgtaccacagctatatatgcagca

SEQ ID NO: 108592 - DNA, 188 bp, Homo sapiens
cctgatcccctcgggggttatttttgggaagggactatgatcattcttgctttaaagttaaactgtaaactgaattcatgattagcttgacctatttgtaggaatgagcaaatgcagttagcttgtgaggtgagaagcaagacagagtgaactatgttagaattttctcactgttacattcacacata

SEQ ID NO: 108593 - DNA, 194 bp, Homo sapiens
atgtggatacccaattttcccaatatcatttgttgaagagattatcctttctccattgagtggtcttgatacacttgtcaaaaaaatcatttacccagccagcttcagtagctcacacctgtaatcccaatactttgcaaggccaagatggaaggattgcttaaggccaggagtttgaaaccaggtataacaag

SEQ ID NO: 108594 - DNA, 821 bp, Homo sapiens
  misc_feature (821)..(821): n is a, c, g, or t
ggcctgcgtgggaaatcttcgattcttgctagcttgcaacatcaagtcaaacctccttaaacctccatgcatccttttcatgacagggttgctgctttaagggtagagggtttcggtcagcgtctgtgtcaacacactcatttaatggttatcaggcaaggctggtccctcagtagggtgggggagggaggctccatgaattcctgggttgactggcatcctcagctttatcatcatcccccagtcactggagggtgaaggcaagaagcaacagtgaaagccacttaagcaagcccctttgatttaatgtttgattttaggctacgtgttggtctgctcgggccgccacaacaaagtatcactgacacagtggcttaaacaacagacaatttttcacagttcgggatgcagaagtccaagatcaaggagccacaacagggctggtttctcccaaggcctccctccgtggtaattatttgaggccttgacaaaaaagtaactgcatacttaaagaaccccttaaggattaacgcccctcttcgtctgatccgtcctaatcacagcagtcctacttctcctatttctcccagtcctagctgctggcatcactatactactaacagaccggaactcaaaacacacttcttcgaccccggcggagggaggagaccccattctatacaaacactattctgattttcgggtcaccctgaagttataattcttatctaccaggcttcggaattatctcccatattgtaattactactccggaaaaaagaacatttggatcatagggatgggctgaagctatgattcan

SEQ ID NO: 108595 - DNA, 291 bp, Homo sapiens
acaaaacaaaaccccggacccattaagcagtcattccgcattgggctctctctctgcccagtccctgacaaacactcatctgctttccctcactactgatcataacaagtggccgttttcaacttccttctttcacttagcttgtttcaaatttcatgtattggttatctatctctttgatatctacctttgttgttgtacctgcatccacacaatttatcaccttaaggagacaattttatgccatgaaacttgctggacctgtaactgtgtgaagtaaatcatacccag

SEQ ID NO: 108596 - DNA, 207 bp, Homo sapiens
gacgagtagcagtagtggagatgagaacgccaaagcagttttcaggtcagctgactggggctacagtgtgtggcaggtcctgcttacattactgccaaatttgtactaaacaatgtcaaagatgacttctgggactccaaagtatgtctagttcataatattaaaaactcatgctgagttggaccgaattcacccttctagatcatt

SEQ ID NO: 108597 - DNA, 452 bp, Homo sapiens
caggggcaggcaggggagagaggacaggctcagagagatgtggcttcagttcccggctgtgccaatggagcctcactttcctcctctgtgaaatggggacaggttctccgctgttcggatacagtgtgataaacaacgggagctctggcacgtgtgcttcagcggtgacagactgctgctgaccctacatttataattctaaatttacgatacattttgatccccaaattaaaaaccagagctgggttgtaggcctgggaatcttcccaataagccacgtggccttggatcacacatagacatcacctcccaatgctctgcagttgccccagcaagaagtcctccaacctcagcttgaatgcttcccagcacggggcgctcaccccctccctggccagcccagctcagcgtgtctcactgctcaccactggaactcacgccctacaccaagc

SEQ ID NO: 108598 - DNA, 346 bp, Homo sapiens
gctagattctgagagggaggcatcccaaaacatgcatccaacagtataaagctgccagtctcttacggtttgaccctgaaattaagaacacatcatattcctctgcatactattaaccaaagcagtcacggcccaacccagattgaaggagaagggacataggccccagctttcaatgcaaggaatgtaaggctgggcgtggtggctcacacctataatcccagcactttgggaggccgaggcaggcagatcacttaaggccaggagttcgagttcagcctggccaacgtggtaaaaccccatctctactaaaaatacaaaattagctgggcgtggtggcacatgc

SEQ ID NO: 108599 - DNA, 696 bp, Homo sapiens
tatcattagatttggctttggttagaggcatttgttagaggcattagctggtttcatcctacaggcgtttcttagatacctgttaggagaggttgtctcatacagagagaggagcaccttgtgctaatgagaaagacttgggatcaagttctcactcttctgcctgtgctctgtgtccccaactgtgaagtggggcaatactacatgctgtatttgtactacatacttgtaaggattaaataaaataaaataatgtgggttaaactctttgaagagctatgcaagggtcagctatttataggattagtgggcatagcttggtgtttagtgtgatatgatgtgtgatatgtgtatatgtgataggaagtatgcttccttctatacacttgacagagtataggatatagacatgtgatatgatgaaatatatatttagtcttcctccatttcctggcatacagctcctaagatccttggaatcgcttaagtgataagtgtctttttgtatgctagtgaattgatgaaagttgggttgatcacaaatggccagtgatttaatcaatcatgcctatgtaatgtagcttccataaaaaaccaaaaggactgaatttggagagtttccagagaaccaaacatggggaggttcctggagagtagcgagcctgcagagggcatggaagttctgagctccttccc

SEQ ID NO: 108600 - DNA, 552 bp, Homo sapiens
aatccttgaaggtggtgatctccttgacttggatttgctgttggtggtcatcttattcacagttaggaaacaaagcctagcactcatgtagtcaaatccatgcccagcagtgaacaaaacgaattgcttatcatgaagcactgttgtggatgggacaggtaattacctctggggaaggagtacatagacctttcattgggtaaatacttaggagtggaattactgtgttatatggtaggtttgtgtttaacttgataagaaactgcttaaaccgtcttccaaagtgattgtatcattttatacttgcactttcagtattcagttaaggctagctttagtttttgaagaggtggcttataattttttcttttttgagacagggtctcactctgtctccgaggctagtgccactgcatctggccctaagttcttgataatagtgcattagatggttgttctaatctatgtttttacatagatagatagatagatagatagatagatagatagatagatagatagatattttttgtgagacggagtcttgctcgt

SEQ ID NO: 108601 - DNA, 622 bp, Homo sapiens
gtttagttaggattttggatctaattgcaagagagatgattaaaatgggattcatgttccgttcacggcccttagctgaaatgtgggctactcagtgaaactcactaacgttcagtttcttcatctgtagagtggatataatagctacttaaggatgttcttgtttaacgatgtaatgtgtatgaaatcatgcaccttggaacctgtaaagtggtatatactcaggatatgaggtatcaacataatttattctcattaaatttcattcagccaattactctgaatttagaatcatggagaatcttttgactcttgatttgattgtttagtctaacagtaatttagtctgacaagtcttgatttgactaacaaatcgtttagactaacaaattgtttagccttgatttgattgaaggattgtcaatccttcaatttcatgccttctacccatttataaacgtgctctgtatactttcgtatagacaataaaatgttgaacaagcccccaaaagatttaggtgatacattgtaagaaactgctgatcagattgatatatccatcacaacaattctaaaagctttttttgttgcctgtagaatttttttttgtaagctcactttg

SEQ ID NO: 108602 - DNA, 312 bp, Homo sapiens
ctcaaaatagaaaagaaaaaaaaaagtaaaccaccttactcggtcctcctaagtcaagcccatgagctggaagcctgtactagggagaagagcaggtatttgagatgttcaagtcctattagcaccaaatggaaactttctccttgatacaatgatagaactgaagaaggaatccctttcctgagtcacggttctgcagcatgtagtatcttcaccacatggcgttaacaccacctagtggtagcaggtccaccctggggaaagactggttctggctaaagcactcttgacccccgtctgggctgagcactg

SEQ ID NO: 108603 - DNA, 424 bp, Homo sapiens
caggagcccttaagagggttgtgggagagagggaagaacatgagaggccaccttctgaacccgatttttgtggtgacagccgcaggcgagatagtggcttggactctggtctttcttctgctgaggacagctgtcctcattgtgaccagttgggaacacacgatagaagaggctccattagctcctgtgcatcccaggagttgccaccctgtccagtgccgtttctgtctgggcttatttccattacacagcagatgtggtcacctcattctttgctctctcctttcctcgccctcatcccagtttcactgtgccctaggagtgctggctttctccaggaaccccttcagtgtctctgtcccttcagcagacacaccctttagactgtgccttcaggaaccaaggcacctggttctgtccctgt

SEQ ID NO: 108604 - DNA, 142 bp, Homo sapiens
ggccccgagcaacattgtatgagtcttgcttgcctatttgccagcctcctcctttcaatttgaactttgctagatagagacaaaatgtgggctgttattaactcagcaatacatttaaaatattgcaactggctgcatctaa

SEQ ID NO: 108605 - DNA, 623 bp, Homo sapiens
aagttcactcgaggttacatatttgggcacaaataaaaacctttacaggccaagggcaataatcctagagactctaaattctccatttcttttgaaatgagaataggaaatcttaggaagctataatataaatgtttctctttgtttgatagtatatacttattgtgcaactactatgtagaagatactatgttatgttctgtgggagacagaattaagttgaagacaaggcccttgcctttgaggagtttgcagttgaatagggaatataatgcatatacataaaattaacactgggaaataatgtgaagagggctatgagttttaaggaaatatattaattggtttgaatttttaaaaaatctttggtgattacagaaagcttcacaaatcaacatggctttttagctaggcaatgaaaaacagaatttggcaattacacagcaggaaacacaattagcctaagtatgaagaagaaagcacaagctgtgtttggagaaaagcaaatggcctcatacatggacagaaataggggaagaaaaaagagtgaggattagacagcaaatggctggaggaaagggagttccaagaagagaaagtgtgtgtgagagtcctgaggtagg

SEQ ID NO: 108606 - DNA, 249 bp, Homo sapiens
agaacatcctcatctgtccttaggaccctctctcctctgtcaccacgcgattggtgggtagccctgtttctggacctctgcttatttccctctgtgatgtagaatcacttatttacatgcttgtctcctaggagacaggaaagcctttgaggatagaaatgatatgataatagttcaccgatcgcacccgttacttattatagactgctgcactttgtgtaattttacttcctcttaaaaaaggaattc

SEQ ID NO: 108607 - DNA, 468 bp, Homo sapiens
tactactactaaattcgcggccgcgtcgactgtgtgcctgtaatcccagctattcaggaggctgaggtaggagaatcacttgaatcccggaggcagaggttgcagtgagccgagattgtgccactgcactccagcctgggagcctagagccctctcaatcttgtttcttatctttcacctcaaaactcctcccagatctatgactctgaggactaaactactaacagcataacatttggctctactttcagaggggtttgtaattcagtgaggggggaaaatgtttttaacctaaaatgattaaatactcaatataaatatactttcaatttcactttattagcagggaatgattattttgagtaataatctttctcttggttcatatgcctagcacataatctgttttcttttctgtgtggacacgcaatttgtcctgattataagcacccagacattgctgcttcc

SEQ ID NO: 108608 - DNA, 283 bp, Homo sapiens
atgttgtatttttcttttcattcagctcaatatattttaagaatttcccttgaaaatttctctttgacctctggattatttagaaataagatgtttaagtttcaagtgtttagagattttacaacaggaatttctgttgttgatttctattttaagttcattgtggttggagaatactctctatggtttcacttgtttaaattttttgaggtttttaaattaaaattttttaattgcccagaactcagtctattttagtatatgctccatgggcatttgaaaa

SEQ ID NO: 108609 - DNA, 108 bp, Homo sapiens
ttcatttcaactatgtcatcagtacctggacataaggacacttgaaacactttcaatataagctctagatcttctgatggtaagtacacaggtagtgtcctgtcaaca

SEQ ID NO: 108610 - DNA, 277 bp, Homo sapiens
ctttatggcaacctcaatcggtaatatcaatgtctctaatttcaggtgttaatttcttgagacatactagtcctcacaatgtatttacatccctggtcaggttgctggagcctatattttacaaattcaaaccaggaaataattagctccacagtggtgattcctaaaccttaacaggcataagagtcatcagagatgcttgttgaaatatatattccagggccaactccagatactgatttagtaagtcaggagtgaagcttagacatttttaata

SEQ ID NO: 108611 - DNA, 127 bp, Homo sapiens
gaaggcttgtgtagagctggcacttctgcttgagcctgaaggctatctggtagagaagcgttccaggtacagggaatgcaagcaggacagtagacggagctgggacaggacagagcgctcagagaat

SEQ ID NO: 108612 - DNA, 659 bp, Homo sapiens
  misc_feature (655)..(657): n is a, c, g, or t
tgagtccctgttaatatgccaggcactgtgctaggtcctggggtagagtggtgggcaaaacaggctctgccctcatagagcttaggaggaaaggcaaacacgtttcagatagtctcacaaataaatatatcattgcaaactgtgatacatgagagcctggaaagagttccctgagggcagtgcagcctcaaagggagagactactctttagcctgtacggtgtgtagagggcttgggagttggaatgtcttagagctagagcaggggcccagggctgtttcctccatttggctcataggcctgatgtctagggcatggaagtgtcttaagggcccggaaaaataaattaattggttccaaaatacaaagaaacaactgcataattcaagccaataaatgcataaatgtttatagagtatatattatactaacaagatcactggacctcagcttgccttgtagagctatttacaaataagaactttgtatttaaattatatttaatgtggaacatgggtacattttaatttgtttgatgtaatgtgcaatgggactcatggaagtcttcaaaagaccctctgattgggcaatgtgttgggttgaattaagttctgccgtgaataaaagaaattaacagtgttattaacagaaaaannnaa

SEQ ID NO: 108613 - DNA, 1976 bp, Homo sapiens
gcagcttagttactatatacagttaatagcaaaccttgcctgacatactcagaagatgaaatatccacccacacaaaatgaaaatctactttgacctattttccaggttaaatgatcttgggtatcttgctttcactcatgaccacaaattcccatgaaaaactggaagaatagaatcctggggaaaaactaacaggatactttttatgtgtactaagacacaagcaaggaaatattcttacagaatttattcacaggagataggatcaaaatcttaattattaacattatcatcctataggatgctagaataatacttagaattttttactttacagccaaaaggctgtttaaaatttattgaacaccaacagtgtgggactgaagtaccttacagaacactgataacataatctttgtctttaagtcctttttttttttttcagacgggatctcattttgttgccagaatgcagtggcatcatcatggccactgcagccttgacctcccaagctcaagggattctcctgccttggccttccaaagcgttgggactacagacacatgccaccatactcggctaattaaatacatatttttttgtagagatgaggtctcactatattgccccggctggtctcaaactcctgggctcaagcaatccttccacctttacctcctaaagtactggaattacaagtgtgagctacggtgcctggcctgagtcttaaattcctaacataatgtacattttttgagcataatacaatacatgacatcattaagagattacgtgaacatagactgagaccttttatggtgaaatcttgtgagattcactatgttttatttacgtcttggtaactgctgactaaatgtctggatgaaaatagaggatcttatgtaaaatgagatgaaaagctatatgtcaagccacatttgtaatcctttaacgcttggcttcggtagtccaaactctacagtaacagagccatctaatggccactgggaccaattacaagcagattgcctgggaattactcagttttcacagtataatggaaccataacgtatgctctgcaaataagccatttaaaaatcatttctaattggttttataatacaatatatttatggaagtatatattcctaatttgttttagtttggttaaaacatgcaaggaggcagtcttagaagcttgtgattagggttaagtatatcattacataaaaatttaaaaatccacttaatgtggctacctaagaatggtttgtatgtgaaaagaaaatgaagaggtcaggaacatgactgccttccttgaggctgctaatgttataatgaagcccctccaactccttgcataaaggaaacactttcatcagctgtatattttctgacacatcaaagattgctcacagaaagcaccatttagaaaatttaggagcctttaaacaaaatgtccattttaaattattctttagcagtgtccccaataagaacttgtaaggaaaacgtttcacaattgatttcattttagtatagtaattggattttccagtgactcatacagaattggcttgattctttggagagatcacagtgatgatgtgtaaatatcgctttggtggccaatggaaatacttcgttaagaaattggaaaaaaatgttgatgggtgtgtgctggactttgcctttcctgacccttacactcaccattgtgacagagattgctgattgtgcccagtatgttttctcctcctcacataatattagaacttctgctgtttagttgggcacatggttgcccagaataaatattcttttattactaataagcaaatttagtaaagttgctagatacaaagagcatgcaaaaatcttgtagctacatgtgccatgtccatctcatagacaatgagatgtaaatgaaagaggtgtatgcaacttccagtaaatgctgtttaagggaagga

SEQ ID NO: 108614 - DNA, 916 bp, Homo sapiens
gcttagtctcataatttggaatttaagataataagtagtaacaaggcaagtcttttatgtaagacagtcaaacagtgtcacttcagggacaaaggcctggaagcccttaaaataagttatcttagatgtgccagaacatattcagagctttattcctttaagcttaaggcttcaatacttgtagaaatgcaaatattcttgagaaatgatacattttttgttctcaatttctcaattctacatacctgattatgagtgaagtatccaaagcaggttttcatcagcatgggggatggaaggtaggtataatatgaggacaatggaaactttgggagaagggagtgaggaaatggataaagagaaatttgaaaattttaggctggacttgagcactattgctgctttcctatgaactatcagaatgtttaaatgctttatcattcatggtccactctcaaccaacatttattatcctttagtaattaaacaatggttttacatacatttttataatgtagaaggaaattcaagattccataatcgtaaaatttttcagatttgtctaatgtgtaatttgtgcatcttcacatgctgctaaatgcagatttaaacattacatctgaggatcatgacttttcctcctttcttggagatcttggtataaaattcatctgctgttataaaatcaggtttctacagagttcgtttcacactaaaggtagtttgttactgtttgcatgaggaaaccatgtatgtctcaatctttaattttaggtggtagtgtttattgttcaccctccctcttgcctccaaaagaatgctgaattatacgccaatatttccatgtgtattctgttgccttgatgcgtactatacttgttgcatgtatattaaaaattttgtactatgaaaaggt

SEQ ID NO: 108615 - DNA, 542 bp, Homo sapiens
gcataatctctaactgaacatgttttattccttcaaaagaaaacactgtaaaaaatgtgtgtggtataaaagaaggaatggttaattttgtttcagtagatcagagaagagtttactgatgaagtgatctttgagttggacttaaatgtaggcaggagcaaaagggcatttcatgcaaaggcagttaagatgtgaagccatatagtacattgagaaaatcattaatatttggacagggtttggtggggaaatgtagggataaacagccccaaaattaagaccatgagaccgaatttaagggcttgtattccataatgagtctcaagacttaaacagatttgcatcttagaagcatcactatggtaccatatagatggttggtgggaagaggatgcagaaagtggtgaggccaaagtgctgggattacaagcatgagcccctgtgcccggctaggtgatgtatttctgacagtagtccaggcaggtaatgctaaggaccttaagttggtaatgtgatagcatgattgaaaaggcagagggaga

SEQ ID NO: 108616 - DNA, 600 bp, Homo sapiens
gggaagatcacagatcacgtggagcgagaccagtggtcaaaaactgccaactacagccaggcctggtggcttatgaaggtaatctcaacggccgggcctggtggctcatgcccgtaatctcagcactttgggaggccgacgcgagcctatcacctgaggtcaagagttcgagaccagcccggccaatgtagggaaaccccgtctctactaaaaataccaaaattggccaggcatggtggcgggcgcctgtagtcccagctacttgggaggctgaagcaggagaattggttgaacccgggaggcggaggttgcagtgagctgggatctcaccactgcactccagcctgggcgacagagcgagactccatctcaaaaaatttaaaaaaaaaaaaacaaaaaactgcagactccaacaaggaagagccacaggacgataccccaggatgcgggaaaaggctacgccagccttggatcccttctgattaatgggcaccccagtcaccaaaggggtagatgcgtttcactcaacctttatccagccatcagagtataacacagggatgtgccatagacagagatggagaccaacaggtagagggg

SEQ ID NO: 108617 - DNA, 517 bp, Homo sapiens
taaattcattcccatcagcctgtaatccctctctattcaccccatctaccagaatgtctttgtttactgttcctttcttcattttaacagtaaaatgtctgggaaaggggtctgagtacataagcattcacttcaatgtgctaattttaaagaattcctgaggcatttaaaaacagaataaccaaagtgactgttttacaaagacattcttatagcaagagttgacaatgtagatatagttgtaaaaagagcaactaggcccaaaaaattatcagttcagtcagcaagactgctcactaatgcaacaatttagagggactggtgccccttaaagggtatatcaaaatttcagtgatttgaaaaagcataccctcgtccctttagggttaaactcagaaatgtgacttcagatatagtcacattagtcttaagtatcattgtaaggaagtaattttctgctcggaaatgtaatctaagaagaatggagacagtttctaaattctgttttacaagtgta

SEQ ID NO: 108618 - DNA, 315 bp, Homo sapiens
cacgagactgatactggatgacacctactaatccggggacatttgtgttcagattctacaagcagcgccactcactacttgtcacttaaagcatgaaaaactacaaaggcagatatctagaaggaaagttccttaggaaggcagtcgtccccagggcccagggttcttcctggaaagcatctgggaagctcttgaaaggtcagaattcattgaatagacgccagaaacagaacccaccactgcctcgttgcctggggggccaaggcaggcggctgggaggcggaggccgtagccagctgagatcacaccactgca

SEQ ID NO: 108619 - DNA, 693 bp, Homo sapiens
gttgcagagagtacataccagcaatagtgattaacaattgagtagcttaaacaactgaataatgaagatgctataaaatattaagaggaagaaaatcctttcaagcagtaagatgtctcaaggtgacattctgctctcagccattattcagccctttgtttgcttagcactcaacaagttttcatgtctggcatgcatagagatgccctgagcacacagcctcattggattcacactgatggttgcctatcattgtaaatagtgacattttcttggaggttcaagtacagaaaatgacttttagtgactccatgaagtgacagtcaactctagacaattttacaactttgttaattctgtctcttctgctctatttcttttgcttttcagttctttcagatacctaggcttctctttttggtttacctgtccaaaatcagtatcctacccaagcctaaccatgtttctgtcattaattccttataccgactcaaaacttctaaacctccagctttgtttggggtattaagaaggaaagttatctgattaagataattcatgataaagtacacatgatttttagttgttgcttttccagtagtcttttaattctaaaatgggagcttttggaaattgtgtgcagtagatgacattgaacaagagccttctcttgtaccttcttacttcctgttt

SEQ ID NO: 108620 - DNA, 137 bp, Homo sapiens
cctcctcttcctgacggttttccccatttcctcccacagacccagacagagggccatccatttcttccctgggatctcaggcacctcctgaccccagagggcagagagtgtcccactctggacccctaggcctcagc

SEQ ID NO: 108621 - DNA, 215 bp, Homo sapiens
ccaggctggtctcgaactcctgaccacaagtgatccacccacctcggcctcccaaagtgttgagattacaggcatgagccaccatgcccggcgatcctctcattttcacaggtggagagactgaggcccagagaggggaaggggcttccttgcagacacacagcagcagaggtagactgggagtcagaagcagttctccagcctcctgggtcagc

SEQ ID NO: 108622 - DNA, 1018 bp, Homo sapiens
ccagctactcaggaggctaaggcaggagaattgcttgaacccgggaggtggaggctgcagtaagccgagattgtgtcactgcactccagcctgggcgacagagtaagactccatgtcaaagacaaacaaacaaaaacaaaaaaacaacattaagtaggtttttaaaagtcacgttaaattttaatctgaacctctattggctgtttagtcattttcttattatgacaggcttttagaaacttttattctgtgatgctttcgtcagtagaggtgtttcctcttagccagttctagccacaatattgactgggcccaggcatttgctacactcagaaggaattaaccaggcaggagaaaacttggtccctactggaatgaatagtttaaaggccatcttagatgctgaaaactctgagcacaaatgaaagcgacccaagaaggaaaaacttcagagcctaagaataaaaaatggtggtagggttgggggataaactcgcccagagctgacttaaagtgctgtcagggaaggaagtgcctttcctggggaggatgagatggtccatgccgggtctggagctgtgggcgttctgatgttggatagcccaccctagcaggctgcagtgtcttaagggtagtggcatgagatctttggaagtatcgatacatttcctaacagtgagtttgagtttgttctggtatgttctgaatggatatgtggctcaaagattaacttagctaaaaataagtatattagatattagggaaatattgttaataaaggtcttctgtccctgttggataactttagaaaataatgtagacaactgaacgtagtggagatgatggcatgaatacagtcagggtttgatgcttgcttcctagaaacttcctagaaatagaacacatctagacatagggaaataaggttccaaagaaaaccttacacttttattcagattttatgttggcctcagttgtactagaaaagcgtttcagtatgtgtctcttggggaatctg

SEQ ID NO: 108623 - DNA, 824 bp, Homo sapiens
ggtttcttagtatcattctcagaccgggatctgggcatcagctagacaggttgggctgcctggagggacccccaagaccctgaaggcattaacatcctctgcttggcctgaacatctccccgcgggggtgaggtggagttgtacaagagggcccttgtgggtgctgtgtgatgcagctgagccaattcccaagggctccttgtgcccaaagactctggacttgacctgagggtgttacttacggagttggccttaggcattcctgagtatcttcacaggacacatggatacttgccacttcctgtcccgcacaggggcctcattctcatggctcctggtctgcggctgttggctcagactccgtggaggcctctgatgcctgcatcagtgttgcattgagtttcaccctaagttgtcacctccagtgttctggactgttctgtgacatatcctagcccttggtgacagtgcttgtgatccttcctgaggtgcccacagggcccctgcagagggaatggagaggaaaagctgctgaggctctgagaccgcacctggaggtctctggacctggctgctgggaggagacagctgggctcagacgcacctgagggaaggctgccctcggctggctgatcacagccattctgtcctacccatgtggtccctgtcaggggcttaaacacacagcctcctcaacactcaggcagtgatgagtgagcagggccatcagtgctgccagaggcctactggccttgccagccacccactccgagccacgtgggcccagaagagagtccagaggacaaagccacagatagaaagtg

SEQ ID NO: 108624 - DNA, 322 bp, Homo sapiens
ttctttagaaggaagaaatatgaaaaactggttttcgttttagagcttaggaggaaaatgggtacttagtaccattattaaactctgggtaagaaaattttgaaataaatatggttatgagattaagttagctatagactattaggaaattaaaaatagaaaggtaccatcattttcataggatttactttttcgtccactgtttatccttctaaactcatcacttataacctcaaatttcagtataaatggccataataacagaaatgccaagctgccatggctaatgctaggaatacagaagtcactacttggataagtt

SEQ ID NO: 108625 - DNA, 706 bp, Homo sapiens
accgtgtgatgacacagagggaagatggccaaaaagaggggcctcaggagaaacccaccctgtggataccttgatcttcgactttcagcttctagagtcatgagcaaatattaatgaatgcctgtggttcaagccacccagtctcttgtactgggttacagcagccctggctgactaataagggagcatacagtatcagaatctgcacaagggcatgcttcatctctattctctattataatacaatgcttaaatatgaaaaaatgatggcaagaaaaccattacaaggaagaaacccataatgactggcgaaatccatacggagagtggagctgtatcagaaaatgccaaagtagtcatgatgggtcaggtttattgagaagtcccagtgggctgaatgcagagctcagtgtctcacatacattttccccttttgtcctcaccacaatcctgtgagctatgagctgttgccctcttcatcttgtaagcaaggaaactgaggcaaggaagttaagtgacatccacgagatttcagagccagccagggtcagagctggaattccaaggcaggtatcactctgcagacctaagttgtttctttgacagccctaagcccttgggaggttgggggccagagaggggtggttgtaggatctattacgataattggttaaaagatattgggacacattgccttaacgatgtt

SEQ ID NO: 108626 - DNA, 549 bp, Homo sapiens
cttgtcccactgggtcacttcacctcaaagtcctcctctgtgagggggagaatagaacttgtatctagctcagtttttggttgtattagtcatggtaataggatgatgaaaacacagcttccatttaattctcttctggttgggctacatcttgaatgctttgttcagttctaattgccacattttgtgagaaatgcagacaaattagaatgtatagagagaatgtgcaatgaattcaggacacttagctgcagaagtaaatactaaaagaggaaatgatcttcaactgtgtgaaaagctgatatatagaaaagagagttgatgcgtcatgtagtaaaaagagttgatttatgtccaaaagacaaatctaaaagctgggaaccaggtccaactaagaaaggggctttgtaataaattgtcataaatgataattagctcccacatttgggagatactcagttggagactggataacagattgctgcaggattttttaattaggaaagaagttggactgcatatattgtcccactcctccattttgggtat

SEQ ID NO: 108627 - DNA, 562 bp, Homo sapiens
gaggagagggccatcgggaatctgggaattaaggaagtaaggaggtagaattggaatgtttaagccaccaagtaactattagattggtgcctgggttttgggtcatgctctcatgtgcttctgcctgcagcttacttgcctccctcttgggctggttggaaagccgtgggctggttactatgggaattgatgggtgctgctggcagtgagagaaggaaagtacttggaattgatacagaaatactaggagagcaggttttttttttgccctctgctttcctgcttactgttttttgatttgatttaactaatgtggttttagctgaagagagcctttccaagagctcacctgtggtaccctgaggaggagttgagctgtcatcactctaacccaggaagacctcatggagaggagggcaacacaaaggatggctagtttctcagatgaatttctgtttcagcaactggcttctcaggcttcattgaactcaaaattaaacccaagcctctttttatactgttaagaaatgtgctgcagacaggagggggaaagtcagtattt

SEQ ID NO: 108628 - DNA, 309 bp, Homo sapiens
gggagcttttaaagactaccattttcccagcctcaacccagactaactgaatcaaaatctctgagggtttggcctgcacctgagtatttttttaaaacttctttaggtgattgtcataggcagtcaatactgagaacccttgcattactgtttgtatgcataaccgctttctctactccaatcccactccactctgaatcttcctccagactgctgtctaattgttcttttaaagcaccactgtgatgatgcaactgtcctgctcatgcagctgcagtggttcccctctgcctatacaataggggccaa

SEQ ID NO: 108629 - DNA, 314 bp, Homo sapiens
aagtgaagagattcaggctgtatttttaagatagcttagcatttgctggtgcattgactgtgggaatgaaggagaggaatcaaagatgtttcccagaatggtgaattacggctatgggaaggcaaggttccttttgcccttgatgacatccttgtgctgtcattgtgcctggattttattcttctgtatatgcacattcctgcttccagccagccctgcccagggaagaaaaatccttccatgcctttggttagcctgaaggctctccagttcttcctttatctgacctgcattcctcatgctgtgcttaggtc

SEQ ID NO: 108630 - DNA, 594 bp, Homo sapiens
tgctactcgggaggctaaggcaggagaatcgcttgaacccaggaagcagaggttgcagtgagccaagattgtgccactgcacaccagcctggataaaaagagtgaaactctgcctcaaaataaaataataaaatgaaataaagatataaattggccagctagagttacctgaagttactatcttcaattatctgaagacagttctgatagcttcagaattctttcatacaaggcaggaatgcaacttgttttttaatggcagataaaatcaaagagcaaaagcaaaaggtagaagcttgaaagaccagagttgctacagattgttattacatgttccataatttaacaattgtcattgaagttggtgattgtcttgatattgcacatctgtaagaagtaatcaaactattgtgaatttgatagaatgctttaagttttattttccaacaaaagaatgtctacatacggcaaattcatagatctggaatccatttatgtcatcaaaagaggatttaaatttaattgtaagcttatatgatacattgttctaactggcaactaatgaaggattaaaaatgaattttgaaaatacca

SEQ ID NO: 108631 - DNA, 555 bp, Homo sapiens
ggttccagtaacatacagtctcttcctattatcgagttgtaatttctttatatgttcttgataaaagtactttaggaagcatttgtgtttgtgctggggatgggaagaagaatggtgataaaagatatgagtggatcacttgaggtcaggagttcgagaccagcctggccaaaatggtgaaaccccgtctttactaaaaatacaaaaattagccgggcgtagtggcatgggcctgtaatccccactactagaggctgaggcaggagaattgtttgagcccaggaggcggaggtagtgagctgagatcgtgccactgcactccagcctggacaacagagcgagactccatctcggcaggtgggggaaagatatatatgaagcctgtaactgaaaaagcaagcggtagctttgtaagcattatttgtggagatgaaggatttgagggtacttttcctagttgcttcagagtagaaaatgggatgggggactaagaggactgctgatatttgaaaaaacggtgggggtggggaggaactaagaggactgctaatattt

SEQ ID NO: 108632 - DNA, 1149 bp, Homo sapiens
gagcagcctggtttcagggagccggactcacgatgtgcttgagaccctcaaattcacccctggaagcagctgcccccgtgacaaggaactaaggacaggcatgtcatggactgtgaattggagtgacatttgtccctcccttcaccaacagactgccccaagagcttcccaagttatctgccatagaataccttgtttccctcgagtctctgaaagggggccgcaaaagctgtccccacgctggaaatgcagggccaggcttttaaagttttgctcccggattatgagaacacctagaaaattcagtgctcctctccactcccccaaaccccttcacaagcccccaccctttgtttaacaaacatatatatagtgctttcctggtaccagatactactttaagcacttgacaaaatatttagtcatacataaaacccttataattacactgtaattcactctcgtcagatccagtcattgtgaagaaacggaggcacggggagattaagagagctacttaagaagacacggtgccaggtttctacccaagccatttggatctagggtctggaggccatgtgagccattttgcattagattaacgctttaattcagttcacagttagacaatatacgttccccatctatatctatacccatctggaaggcaacaaaaagataataaactgatagtgtcatgtgcccatgacccagctaacaaagaggctctgggttccaatgccccagtctttcatgggattccatcgacctcatgccctgctcccctccccaacagagatggaaacattatcctgaattttgtgtttatcatcccttgtttctctctatagtttttccacttatggttgtatgatttttgtttgtttgttttttgagacggcatctcgctctgtcaccaggctggagtgcagtggcgtgatctcggctctacctcccaggttcaagccatcctcctgcctcatcctcccgagtagctgggactacaggcacacgccaccatgcccagctaatttttgtatttttagtagagacggggtttcaccttatggttgtatctttaaacaatgtcttgtttagttttgccatgtttttggactgtgaataagtagaattattatgctgtgtgaa

SEQ ID NO: 108633 - DNA, 357 bp, Homo sapiens
aagaaatggataagttcctagaaaagtataacccaccaagattgaattgatgagaaatagaaagcttgaacagaataacaagtgaagagattgaagaagcaattaaaaaccttccagtgaagaaaatctcaggaccagatggctttcgtggttgatttctacaaacatacaaagaagaattgtcaccaatacttcttaaagacttccgaataatagagctagagggaatacttccaaacatattttatgagaccagcatcatcttgataccaaagccagacaaaaacacaagacaagaaaagaaaacttcaggccagcatctctgatgagcattgatgcgaaaatccttcataaaat

SEQ ID NO: 108634 - DNA, 1199 bp, Homo sapiens
gaagaatacaatgactactagtacaggttgctactgccttgatttatattaatttgccaccatttttacacacttctgtttttatgccaagagttgtgacttcagatacctcctgaaagtggcttggattctccaggtgtccatatgtcatactttggaaacggatgatatgaattacaatgtgttgccctctggatttgtgcactgtactgtgtgcacagtctgcatgaaaattgcgtagacttcagtgtgggaaaattaggtgctgaactgactgattctttgttgaggaggatggtctcaacatcattatggagaggccaggtgtggtggctcatgcctgtaatcccaacactttgggaagctaatgcaggaggatcccttgaggctgggagtttgagaccagcctgggcaacacctggagacttcgtctctacaaaaaaaaaaatgtttttaactagccagtcatgttgagcacatactgtgtagtcctagctactcaggagactgaggtgagaggattgcttgagcttaggagttcgaggttgcagttgagctatgatcatgccactacattccagccttggtgacagagtgagatcttgtctcttaaaaaaaaaaaaaaaaaattcattctggaaaattttttctttggggttgatcattttctccagagagaaatctagcttctagctgagagtgctaggttggggagtgagttctctggctgttggcattctggaagccaggcagggagaaggattgttaagtacgtggacttttactaaaactttgttttctcagtatctcatgcctgccttttacttttcctggtgttcataagtctagactatctccacttcagaaagttaacttttaggctgggcacggtggctcactcctgtaatcccagcactttgggaggccgaggtgggtggatcatttgaggtcaggaattcacaaccaggctgacaaacatagtgaaaccccatctctactaaaaataaaaaaaattagttgggcatggtggaacatgcctgtaatcccagcactttgggaggccgaggtgggtggatcacctgaggtcaggagtctgagaccagcctggctaacatggtgaaaccccgtctgtactaaaaatacaaaaattagtcgggcatggtggtgggtacctgtaatcccagctactcagggggctg

SEQ ID NO: 108635 - DNA, 677 bp, Homo sapiens
gcttcctttgcctatatttgcagatgagtagttttctcagttttgtgcctgcagaagtgcccaaagatatccaaattcatctcttcattttccattatctctgttcctttgagtctaatttagtgtaatactttaaacatttagaatttcatacgaatcatgttataattcactgcattacagaagaacacatccacagctatcttcaccataagcctatctctagctaagtttccctgtaaggctgcagtgggacatcccattatttttagagcctttcatcatttttcagaggttcaatgagaccgcactactgtaatcttcctaaggtatttttttttctatttttatttgattctagtctagtccatcctgaggtcttagcaaagggttttacagccacatccttggctcacctgaagaccatgttttcctgatagcccttgtgcttgatctttgccctgaaaccatttcttaattttagtgtaatttttttttgtctagaaagaccgggaatgggaaatagtttcattgtttaaacaatcttggcttccttattttagcagttccttttttggtcatttctcttctcacattttactataggtagtgagaagaaaccaagtggcatttttacttttatatctgttgctgataattacacaacaagaagatga

SEQ ID NO: 108636 - DNA, 387 bp, Homo sapiens
ataaccattctgtatattggatattgacttctattgacaaaatagccataacaatattctgatttagaataatactccttttctgctgtatatttgcaagcttttatcaaatattacgggagctcaatagaaatcaacaatatgaatctttatttaccacaaacattattgatgcctatgcttgtttttcttaaaatccattagctttttatgacacatttatactttttcagttgtttattactgagaagtggctgtcctgccagaaaactgctattctcagctgtatccacaatgactaatagtgagtggaagtgcagtggataaaagcaaatgtgtcttctctgtattttttttcatccattggctaaaaaacaggaggatgca

SEQ ID NO: 108637 - DNA, 734 bp, Homo sapiens
gaaaaagtgtatatcattgcatcaaagggaggtgagatgttgacataagacttgtgccaaaatggaactgaaagcaggagagatcaccgtcttaaaattctctgctctaggattttcttaaaaataaagagaaaaaatagatgaacaaataccaataagcatttgttgaatatccactgcatcaactataagaataaaaagttgcaagtaattaacctttctagatctcagctttaactataagatggaaatgatgaacacggtctacttcaaaatgttatgttgaggatatgacgaaataatggttataatagttgctggcacattaatgcttcataagtgtaggcccccttcatcctattacttttgcttttaacacagttccaacaagttttataatttagatgatcagcccgtaaccctccatcccttcagcttgatagaagtacaaagagaaggctagggaaataagtaatagctgaaacagtgtcgtgatacagaggagaaaagaaacgctaaaaccctttataatatgtaaatgtacatgctcaagatatagagctcttgaatatttaatgaaataaatgaaaataaaccattatagtctgtgcagacatcactgtaatgtaatttattacaataagagatgtttgttatgaatgatcccagtgagcaaatccacatttatgactagtaaaatgataactactactacatgttaaggattatcatgt

SEQ ID NO: 108638 - DNA, 478 bp, Homo sapiens
ctgggattacaggcctgcgccactatcacccggctaatttttgtatttttagtagagatggggtttcaccatgttggctgggctggtctcaaactcctgacctcaaatgatccacctgtctcggcctccaaaagtgttgggaatacaggcgtgagccaccacgcccggcctcaatgccacatgtttaacattttttgccatgttgtccaggctggtctcaaattcctggactcatgccatcctcctgccttggcctcccaaagtgctgggattacaggtgtgagctaccacacccggccagctttggagattttaaagttctcgatagtaagggctaggtttaattccttgaaagcccctaagacctaaatcagtgttttatatggactgatttttcaatgttcactttaagagactttgtatgacagtattctttacataatcacttttggtaacttctagtaaatttcctctgaca

SEQ ID NO: 108639 - DNA, 111 bp, Homo sapiens
cgttttctctaactcgctcaggtacaacaatcagacagcgcatgctacaaactctggccagcattttcaattatctggcctttttccctcctgactgccagccctgcaaca

SEQ ID NO: 108640 - DNA, 829 bp, Homo sapiens
tatgatggttccatagcactgcagcctgggtgacagagtgagaccctgtctcaaagaaaaatttaatgaaaattcttggcattataatttaatatttttcctgctctgttctctactttttcctcctggtattccagatattcctggtatgtctatctcacatatttggatattatcctataattcttggatgttcatttgtgttcttaatttttttcattaatttttggcatgtcttgtacctttttcactgaacactagacatgttgtattgagtaatagtcactaaagaacacaggctattagtgtaaggatttgtgttaatctctttggcctcccaagaagaaggctgtaacagttaaatccaccccagtgtatttaccttttaactgcagacgctagaggctttaaattgctcctctgtccttatctttttctcccctcctgactctgggctctcctggatgcttttcttagggggagtctgtagctcttcaagctgtagtccactgttattacacaggaaccctgttggtgcagtggtgaggagtagagatgggcaagcattggaatctataatcctatgactgagtctcagccttttactgtgtccgtgtccctgggctgtgaccttcacagtcttttttgtcttcctagctgagacagcaaggctggagggggctagagtgggagcaatgcccctgctccacctgggatgatgctttagcaaagtttttcaccttggggagcagtctattgttatggagaatgctctggggttatttcacaataattttacagatcactttctcctgtcagagacatgagg

SEQ ID NO: 108641 - DNA, 347 bp, Homo sapiens
catatattttttttttgagactgagtctcgctctatcacccagtctggagtgcagtggcgcgatctcggctcactgcaacctggctgacagagcaagactccatctcaaaggagaaaaacaaaaaacgaacaaacaaaaaaacacaaatgaaaccaaaccaaaccaaaatgcaagggacccgtggcaggtgcctgcatctctgaggctcagctgctcattggtaaaatggggacactgtaactgcctcgcagggcccttacaaataaaggaatgcagagccattcccagaagccagggcttggcagctgctcaagaagagaagtgacaattaataatgacaggctgg

SEQ ID NO: 108642 - DNA, 315 bp, Homo sapiens
ctatcatgaaaatgcctcactgagcaattactaacactcttaatacaaatagaaagtagaaaataaatagaagatataaaaaggtaccaagggaaattatgtaacaaaaaatacaataattgaaattaaaaactcactgggctgcctcagtagtggacaagagatgatagaggaacgaaaaatcgatgaactcaaaagcatatcaatagaaatgtccagtctgggccaggcatggggactcatgcctgtaatccctgtattcacaatttttggacgttttgggcattgggctgtatcctttggcttgttccgctg

SEQ ID NO: 108643 - DNA, 446 bp, Homo sapiens
tgcactaaagatattcagtgcaaaggtacataggaattttggccagtctgcatatgccttgtgtgactgttcacagttcacacagttgttcgtttaactctttattacctgaattttgcaacattttcttctctctgcattattaagtagtggccttaataaaacccaagtccagacgtgttggttggctcctacacctgtgtcaaggagaacttgacgtctgatacattaatgggccttcagcacttctaagccagaaagccaacatcccagacacaggaattttcacctaagaacttgaaagctctaacaaactgcgaatgattagttagggttatattcaacatttagtcattatttctaatgttctaaaaagagatactgcttaactaaatgatcttattccacatagggtagggagggttggtgattttgatatatcacta

SEQ ID NO: 108644 - DNA, 403 bp, Homo sapiens
cctcagaggctcggaggccaaagctgctgtgtgtcctgcgtggagcagtcagagaggtctcaggcttcgtgggtggctatggtcacagctgcccaacccgagccccccatgctgggccaggcctctaagtcctggcagtaacccagccatgctatattcattccattttcagaggggaaactgaggcatggagtactttgacacctctcatgtcagaatcaggctcttctccttcctgagtccgggtgtgcaaatggccctgacactcggggcttgtcacagcctggctcagagcctctcctctccctccttccaggctcagagcctctcctctccctccttccaggctcagagcctctcctctccccccttcccaggctcagaccctctcctcttcctcctt

SEQ ID NO: 108645 - DNA, 362 bp, Homo sapiens
cagatttgttcattttcaacagatgactgcaggaccaacgttgtcacaggggccagcattctctcaccaggcaaagccagccgcttctctgcctggtatcaagctgcctgggcagccaattcgtaatcagagtgccaatttataagtgtagaatgagaaatagaactgccacaggaagcagaatcactgcctggtcggccctgtgggactttctggagacttctgtcaaatatgctcgtgtaagactgggagccatgaataaatgcacatttttgtttgtttttgtttttgttttgttttttgagacagggtcctgctctgtctgctggagtgctgtgatgcaatctccacctcccgggttc

SEQ ID NO: 108646 - DNA, 1028 bp, Homo sapiens
ccaagcctcttgatttaaaaatttctacagaggttttagaaattaccttataattctggaaaaatatggctctaatgataatttaactatgttagcagtgacatatttggcaaataagtatttttcatgatcctgttacacaggttgctagatgaaatgatttttaagatttaaatgtaataattaaaagaactaagctcttccctcccctttaaaaaacttcttttctcaaaaactattctgttaggtaacagaaatccaggactggagtgcatcaagcccacatagcgcagcatatgtcctctgggataatggtgctaagaacctttacagagttggctttgagggcatgtctgatctgaaatgtgtccaggatgccaagggaggttctttctacagagatcactgccctgtgctaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtggaccttcaatcctgctgttctcactaaagcgaacattgtccgaagtggagatgctgctcagggtgcagaaggaggcacctcgcagtttcaagtgggtgatcttgtacaagtttgttatgacctggaacgaattaaacttctacaaagaggacatggagaatgggctgaagcgatgcttccaactttaggtaaagttggccgagtacaacagatttattcagacagtgatttaaaggtggaagtttgtggaacatcttggacatacaatccagcagcagtttccaaggtggcatctgcaggatcagccattagcaatgcatctggtgaaagactctcacaactcctgaagaaattatttgaaacccaagaatctggtgacctcaatgaagaattagttaagg

SEQ ID NO: 108647 - DNA, 740 bp, Homo sapiens
gactgggttctcccagctaggtcgcagtgggcgatggggatccccaagggtgggccgagagctgacggatcggcagcgctggttaaggccccgcacctgcagccccagtgaccttgaacgattccgctctgcggcgggtgtccctaaactagcagtttagggtgtcaggcatcaagcatgatggaaccatgtgtgatacctgccgccagcaaccaatcattggcattcgatggaagtgtgcagagtgtacaaattatgatttgtgcacagtgtgttatcatggagataaacatcatttaagacatcgcttttaccgaattactacaccgggaagtgagagggttctgttagagtctcgtaggaaatctaagaagattacagccagaggaatctttgcaggtgccagagtggtgcgaggagtggactggcagtgggaagatcaagatggaggaaatggacgtaggggaaaggtaacagaaatccaggactggagtgcatcaagcccacatagcgcagcatatgtcctctgggataatggtgctaagaacctttacagagttggctttgagggcatgtctgatctgaaatgtgtccaggatgccaagggaggttctttctacagagatcactgccctgtgctaggtgagcagaatggcacggatcctgggggttgcgattggtggcctgtaattttgattcgactcgaattgtcgctttggcgctggtcgggggtggcgggg

SEQ ID NO: 108648 - DNA, 725 bp, Homo sapiens
acatgtaaaactaaatgtaaaactaaaactgtgtttgttgtgctactaagaagcacacatctatgaaatctaataataggggaatttgacttaattggtgaggtcaggaatgttttccttgaggacatgatggggtccagagagttactagacaaagacagaatggaagaggattccacgtatttgttgattgagtgatataatccagctttctatgtatctgggcttcttttctttgcacatattgttaacctctcaatctttaatcatctctctgggcttctgtgataataaaaggtaatctatagctctggtgcctctaatgttatacaatgaagaataccctacatgaaaatttcttttttttttttttaactgaaattttaattttagatccagggggtccatgtgcaggtttgttgcaagggtatattgcatgatgctgaggtttgggcttctattgatcccatcattcagactgtgaacagagtacccatgaaaacttttttttttttttttttttttgagaaagggtctcgctgtgttgctcaggctggagtacagtgacacaatcacgactcactgtagtcttggcctctcaggctcaagcaatcctcccacctcagtctccttagtaactggactataggcgtgtacaccaccatgtctggctaactgttatttgtggagagaggtcttcctatgttacccgggcttgtcttgaa

SEQ ID NO: 108649 - DNA, 490 bp, Homo sapiens
gcagatacatctaagtaggtttcaactgtctaagggcacatgcctggtgcagggacatgaacaaattgtgagtaaacagggataaaagccctatgagggatgtttaacattgaaatgtataaagtttttatttaatcacaaagttttctatattggctaaaattttataatgataatgaattattcatgtgaaaattaaaaactgttttttttgtatttttaaagaaaaaagcacaaatacacccatagaacactgtgaaatattatctttcacaatgtacaccaggccaggaaattattgggctaatttgagtcttcaacaaaattttactttgtgaagaaataagacaatgctggagggaccaaggttttcatttgcctgtgctccttctgatgccatctttactctccaggtgaaaggatgtttctgagatcaatattcctctcctttgatagttaccttcttttaaaacctactgaacactgactt

SEQ ID NO: 108650 - DNA, 520 bp, Homo sapiens
tacataaaacagtgatgcctttctttcctgggcaagctttatagtttctttactgataaggtgagaaagtcaaagaccgaaatgtctggagtcaaatgtctccaaggcattaagaggaaattttaatttgactagtaatcaaagaaatgcaaattaacataatgcaaatgtttagaaaataccatgccaaggatacaggaaaattcacttgtgcattttatactctgctattaggaatataaattgtcaaaatttttctggatggtataaagagttctttaaaaatagctctgacctagtacttctcttaaggatttatcccaaagaagtaattggagctaagactttagacacaattgtaataatgaaatttttaaaagcaacctaaatgtctagcagtagtgttagtaagtatattgtggtatttctgcaagataaatacagtcaagtcattaaaaatcagaaggcttacttaatgacattgagaaatgctcacgttatattgcaaagtaaaaaaaaa

SEQ ID NO: 108651 - DNA, 159 bp, Homo sapiens
tcaattccctgcccgtccccaccacctacactgctgagtgtgaggaggcatcttctgtagtttcccatccattctcaaaaaatatttgctcaatacctgtagtcagcattgttctaagtaccgggcataaaacagtgaacaaaaaagacaaaaaggctt

SEQ ID NO: 108652 - DNA, 559 bp, Homo sapiens
aaacattcagacctggaatttgatcatactgttcaccagagcagccactggagacacctgagctgaggagtgggtgccattacctgcttcatattttgagggtagggctacttctgaagtgacgtgcatcctctccagatagccttgatcctggcttgggccttaaatattggctttgttcctgttctccctcaaaagtgtggccccaaatttgactacatccaagttagaaagtaagtacagaatttctgaggggaacaggtcctaagatgtgaaaataaataaactgtaggccatgatggaagccccagttgagaactggtgtcccagggaaatctgagagtatggaaacggagctagaagtttccctgtgagggctggagttctgatccacttccttcaattagagaggtgatttttttttcttttaggtaagctgtggaggccaatcatagtcctgagtgataggctaatatcactccacacacttccctgttgccatccctggcctattcatatcctctccttctgcaaaagaggacacctaccttctgcagca

SEQ ID NO: 108653 - DNA, 257 bp, Homo sapiens
atgctttctagaaaatgcgagtctgttatttaggaggatgaagtattcagagaaactaagtgacttcctggagacttattggcaagatactggagttattaggatgaaggtcttctgatttcttgttcagagtttactaaggaaccctggaaagttttggtgaaccattttaccctataaaccctatcacatttatcaaatgagtccttacaatttgcatcttatcttgtaaacagaaataaaaaaaatgataatta

SEQ ID NO: 108654 - DNA, 572 bp, Homo sapiens
gggagagagggatagggaaaggatgaaaggaaaacttgagaagattccaagttgaaatggagcctagttaacagtactgcccatggtggcttattccatgtgatccatcaccattgttatcaaagtcccattctgtgttctcatctgcttacatgcttagcccttgactttctaaatgaatacacggtttaaatttttcatgtttcctttatgtttgtcaattttcaagttttaccctctggaatggttggtggctagttaacaaatcatactgatgaagaatataggctctggcccaggcaccgtggctcacacctgtaatcccagcactttgggaggccaaggtgggtggatcacctgaggtcaggagttcgagaccagcctggccaatatggcaaaaccctgtctctactaaaaatacaaaaacaaaaaattagcaaggcacagtggcacatgcctgtagtcccagctgctggggaggctgagacaggagaatcgcttgaacccaggaggtggaggttgcagtgagcccagattgtgccatcacactccagactgggcaaaagagcaag

SEQ ID NO: 108655 - DNA, 520 bp, Homo sapiens
atcactgaactttccccagattattctttccttttttgaggggaaagctggatataaactggcagttaaaaaattgtaaagaaatcaacttgctcattttcattgtgtatttttgctctcaagcattttccatgaactgtgtgtggattcattgtctgcattggatgacgaactcttgagtgttgctgctaaggtaaagtggtctcttgtaaaattaattttctcactctgaatgtagttttgcatagtacttacttttcaaacttagcagtggtttacctatcattgttttatggtggtaatggaaagtgggtcagagaaaaacatatatgtggctagttgactgaaaaaatttgtttaactttggtaactaacaaagattgataagtactgtgacagggtaggagctgaaaaaaatgaactggaaaataagtagtgagaggaaaatcacattaggaagtgctttctccaatagaggaaatatgaaatttgattaagctttatttggataaatactaat

SEQ ID NO: 108656 - DNA, 378 bp, Homo sapiens
acctctattactgatctaagaattcttattttagatgcatatacagctaaattaatgaatctaaatggatagcaggacaaatttgacatgagcaatttttcaaaaaaaattatttatttgcttttaagaggagaggctatgttgctcaggctaaactcaaactcctgggctcaacggatcctcccacctcagcctccaatacaagtgtgcaccaccgtgcccagttaataaacatttaaaaagttttacaatagttgcagatttacagaaaaattgcaaagatagtacaaaaagttcccaaatcttccaagaagtttctcttattaacattttatgatgtcagcaacttttagtgatagctcaatagtggaaagtcat

SEQ ID NO: 108657 - DNA, 358 bp, Homo sapiens
gataacacctcaggggactcacatctgattcataccagacgtcgagaggaaggaaatgaaaagtgaggacagacattccttccctcggctgagtggaagtcccagtagtcataataactagcagtcactgaacatgtgtggtatgccagccactgtgctaaggactataatgcacagtaaatgttaactcttccagttactgagtgcttactctgtaccagccactattccaggagctttacaagtattatttcatttaatccttgtgacaaccccatgagatgaatcctattattatcaccattttacagataggaaaactgaagtagggagagaagaattaactttcccagggcca

SEQ ID NO: 108658 - DNA, 112 bp, Homo sapiens
tcaggaaactggatgggtctcagggtggtcttttcccaacaaagatctggaagcatctgagatatccagcagcctcatttccatataaatgtagtgcagtgctgatggattg

SEQ ID NO: 108659 - DNA, 254 bp, Homo sapiens
gtgggactacaggcacccaccaccacgcctgactaattttttgtatttttagtagagacaggttttcaccgtgttagccaggatggtctcgatctcctgacctcatgatccgcccacctcggcctttcaaagtgctgggattacaggcatgagccactgcaactggccctatttgaaatttttgtactttcttgttgtaggtacttattgctataaactttcctcttattgctgcttttgcagtaccccatagg

SEQ ID NO: 108660 - DNA, 195 bp, Homo sapiens
cattcttcagtttatatttgcttgatcaaccaaaagaccagccagcagggcactcttgagtcagctctgaagagatcagctggctaagatgatttttccagtgctcaacattaacttgatcatttccccccacccaaaaaaaaaatgcttaactgcagagagcactctactctgggtgacagagtgacgccctgt

SEQ ID NO: 108661 - DNA, 682 bp, Homo sapiens
tagattctggacattagtcctttgtcagatgcagtttgtgaaaattttctcccactctgtgggtgatctgtttactctgctgattattccctatgctgtgcaggaggcctttagtttaattaagtcccatctatttatctttgtttctgttgcatttgcttttgggttcttggtcataaactctttgcctaagccaatgtgtagaagcattttcgaatgttatcttctagaatttttatggtttcagaccttagatttaagtctttgatccatcttgtgttgatttttgtataaggtgagagataaggatacagttttattcttctacatgtggcttgccaattatcccagcactatttgttgtatacggtgtacttttcttactttgtttttgtttactttgtcgaagatcagttggctgttaagtatttggctttatttctagcttctctactctgtcccattggtcatgtgactatttttataccagcaccgtgctgttttggtgactatagccttgtaatatagtttgaagttggataatgtgatgcctctagattggttctttttgcttagttttgctttggctttgcagactcttttttagttccaaatgaattttggcattttttttctaattctataaagaatgatgatggtacattgataggaattgcattga

SEQ ID NO: 108662 - DNA, 405 bp, Homo sapiens
ctatctcagattcccaaagtgctgggattacaggtgtgagccaccatgcctgggttttccttgttgataaatgagcatgggattgttctagagaaactgtgccatgagctgggtgggacaggagcatcaagatcatttcagaaagttctctcgtgaaagccaaaatatgtgcctactccacctctgcccgctagctaccatgtcccaggccaaaaagtccttaggagaggagaatcccatgcaactgtggagtgtgtgctgggcccagtcctgggttcctcatccattgcctgccttaatccccaaggcggctgtggggcacagatttccccatttgacaggacacctcaaccagcggttctcaacctcactagtactgacatgtgaggctgggtgcttctttgc

SEQ ID NO: 108663 - DNA, 144 bp, Homo sapiens
ttcccccagggaaacaaaattgccctcggttgagaaccactgagttacagggataaaattatcagatgtgttcgttttataaaagaatttaataatattttaaagcatatcacatatatttttgccgaggctggtctatttgat

SEQ ID NO: 108664 - DNA, 415 bp, Homo sapiens
aaaaaatggcctttctctccttgctaaaaattcacccagcactggccataaaatatagtccatgcatctgtaacccctgagagaattatttccttatggaactcagctctgttcctttgcctgccttgtagagggctggttcttgttatgggaggcttttaaagtaccaaagtaataatttgtgaagtaaggcccatgaactgcttggtttagcaaattgtgactctagaaaataatatttgaagctggtctcaaaggctggattaaataggaggtgcccatgtttacccaagccaaacctggtagccatcccctcagagcctcttctttgccccatgcctcatatatgccattatcataaaaataacaagagccctctattatttagggcctactttagaccagaaactattaa

SEQ ID NO: 108665 - DNA, 479 bp, Homo sapiens
aagaaagaattttgtacatgggcggggaacttgaaactggtagaaatagaggtggtcttagccagattgaatagtctgtgcataacttctcaacagataggggtttagttaacagagaagcatctctgaggtagaagcatctgaagtactgtgttttacagagacagatactagcctgataatttacaacagaattatcaccatgtttaatggtttcattaatgcatgactccatgatctgaagcaaattttttaaccacccagagtttattttctgggaaatgagaatgtctaccttgtaaagtggtttaaggcatgtaaaataatgtgtggcatttaggtattcaatacatgctagctgctattattattgttactgtgggaatctaatttttttatttttgagagatagggtttcactttgtcacccatgctggagtgtaatggcaggatcatgactcactgtagccttgacctct

SEQ ID NO: 108666 - DNA, 402 bp, Homo sapiens
tagatacaaaattttcagtgtagaattgaaggtgtttcacaaatagtggaactaacttatctttgcagccattttttccccccatttcttacctatattcagcttcactaacgtgtttccttactctcttcccaaggtactctgggcttcccccttccctcgcttgtgactgacttaccatttttttgtgtgaaggttccctaggccactctttgacaaacttgaatttgcattcagcccacctgagttcacattcatttctctcaaaaaaattttgagtttgatacttcactttctatatgtcttttttccccacctgcgtggttttgtttgttggcagatgttgtattttatagtaatttgcgtcttttatatggatgctccaaaacagttcttgattgg

SEQ ID NO: 108667 - DNA, 465 bp, Homo sapiens
caagctctgggatagcatgtagagtgagcagaggcaaggaccagaaccgggatggagtgggatggaggctgtactaccagtgctgtttggtttgggccaggggttagcagggaggttagaacacgggcagagaagagatgctgatgcccagatctgacagtggagtctaggacaccaaggccagccttcaatcctgtctataagcaggtcaaacattgaagtcattctggagagagtcccattttattatctgctcaaatatccccgtattttattgtgaacattgcatactcacacatcttttttcacaccaaaaatgcacccaaaccccaagtctccatctccatctcagccttctctttcctgcagttgactggggatcttcattcagggaccccaccaatatctcaaacatagcctgtgcaaaactgaactcatcagcccacctaccattctctctccact

SEQ ID NO: 108668 - DNA, 389 bp, Homo sapiens
ctctacagtgcccagagtccaaacagtgcccagagtccaaacagtgcccagagtccaaacagtgcccagagtccaaacagtgcccagagtccaaacagtgccaaagctgctggcagaacctgacactcctcatgccgtgtgtccctgctcccgtatcattttacgccacctacccacagcgcccagtatccatcacacccccaccctgccccaaagctaccattttctttttgaaattgtattcaagtgtggagaccccccaactgctgtcaactgagcccttctgactctcaatcagatgggctaattccctgtcatacccggcacagttgtgacagtcctgtgtgtgttgtgtcctcctctagaccatggactcctgagggtgtgag

SEQ ID NO: 108669 - DNA, 259 bp, Homo sapiens
atctgcactgtttgctgtcagcttaaccttcctcagactgatctcatcatcttccttctctcctgtcatctcagctctgcctcctcccagtgttccatgttggctcatggtatactgcccaggcactagaggtatccatgattgtggcctgttgccatttattcctttgagatgtccctgtcaactaccatggtaacccaccagttgggcttcagaccttcgtctctctttaccccactttaaggcagatcagctacat

SEQ ID NO: 108670 - DNA, 700 bp, Homo sapiens
aactattttgcttttaattcagtttgtagattaaggaggcattatatagattttttagtaatttttagtaactttttttaagtgaagaaattcaagattctaggttattactggtggaggcattagtgtgtttcatatcatagttcattgtttattgatgaattcatacacatatgcaaaaaaagataatagatgctcagcagaaaaaaagttcaataagtgctgaacagggtgcttaacatagcagtgaacagaaaggggcatgatctttaattacagtgtaaaaagtgctgcaactggattgtaggggaagagcccatacattacaggggcagctaaccttttctgagtggtttgtgtaagttcttgatcaaagctaagatctgaaggataatttaaactttggtaattatagctatattttagttttaaggtctaaggaatatactagataatttgtcagaatatctaagtataatgataatttttcttcagaactataaaattacacaaagtctgtcttctttttgaagtgagataaaattttggcatcaaagctaacttttaaattatgatgaataatacataattaccagaaaattcttacttctgaaataaaattattcaacattatttttatcttagagtacgactttctgtctcatatttttgagaactgtctactgccaacataatatta

SEQ ID NO: 108671 - DNA, 389 bp, Homo sapiens
gtcttggctctgtgcccccagtgtttgagcacactgtctgggaggcctggggactacctagcccagtccatcacctgtgccacacacctgagcactcctcctggtggcctgagattgagcccacccaacctgcctttaatcactgcagcaggcacccatctgcatgtaccacctgtgggcctggggactggcttgcccagcctgtcacagtcaccatcaacatcagcatggactgcttggaacccagaggttagtcctgccattgctaatgacatcaccgaagccatatctgcttccagaggccaaagaacccacctggccacctgcctgacccactgctgccactactagcacctgagcaagctgcctagaggcccaagaatcagcat

SEQ ID NO: 108672 - DNA, 588 bp, Homo sapiens
tgagagggagtcttgatctgctgcccaggctggagtgcagtggtgcaatctcagcttactgcaacttccgcctcctgggttcaagtgattcttctgcctcagcctcctgagtagctgggattacaggcgtgcgccaccacacccggctaatttttgtatttttagtagagatggggtttcaccatgttggccaggctggtctcgaactcctaacctcacgtgatccgcccacctctgcctcccaaagtggtgggattacaggcatgagccaccgcgcccagccatgaaatggtttttaatgacacatttcccagagtgcccagtggttcttactgccctaggtaagctgcctctcagactcctcaaagcagctttacctgcttcctagacctgtatcctaacactcatccccatagatactaagctgtaaagggattaaatgctaatgtggaatttcatccaagaaatgattaaggatattacagatgtgggtgggagtgattgcagactagtaaggttagctagacttttaaacccttgctcttttctgaaatcctccctacttttcaacttcttctaagtaccaga

SEQ ID NO: 108673 - DNA, 893 bp, Homo sapiens
agcgggggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgggcacgtgcacatcacagatttcaacattgctgcgatgctgcccagggagacacagattaccaccatggctggcaccaagccttacatggcacctgagatgttcagctccagaaaaggagcaggctattcctttgctgttgactggtggtccctgggagtgacggcatatgaactgctgagaggccggagaccgtatcatattcgctccagtacttccagcaaggaaattgtacacacgtttgagacgactgttgtaacttacccttctgcctggtcacaggaaatggtgtcacttcttaaaaagctactcgaacctaatccagaccaacgattttctcagttatctgatgtccagaacttcccgtatatgaatgatataaactggatgcagtttcttcagaagaggctccttccacgtttcattcctaattaagggaggctgaattgtgatcctacctttgaacttgaggcaatgatttggggtccaaacccttacatagaaaaaagcgtctgcaaaaagacaagatatgcgaaagcgatccaaaatttttcaaaccctgacttgcaagggcaattccggaaaagaagggttaagaccatcctgaccccccaggtgtgaacgagcgtttgggcactccattt

SEQ ID NO: 108674 - DNA, 245 bp, Homo sapiens
actttggttttcccacagactcctgaagaataggtcagaagaaagggttaaagccttaaaaggggaacaaccattgcggggctcagggaggaggataatgttctttgggctgccgcaccctgatccccggggtcccgaaccctcccgtccctggccaggcctgccagccacagggtgagggcccccttccgccgcaacctgccactctcacaccaatgcgggaccgccttctcttccttccgcac

SEQ ID NO: 108675 - DNA, 1466 bp, Homo sapiens
ggcccaaatctctttttgaacaaaaaaaaaaaaaaaaaataaaatcccaaatagactaaaagggaaaatcctaccccagtcaagaccctacacaaccgtaaagccaggggccctggggctaactaattaactgatttcaatcctcagtgctccttcttaccacctatggcctagaaagaagactccacttctcagtgcctcattgtcctcatcatccttattccagtctgttctctgagaggcttttgtaaacttttaaagttctaccaaggacatgaccctcttctgttcacaaatctccatacatcccaggacactcagattgaaggcacaacccctaagacaaccaatacaggtgtgactctggctcatcttcagtttttactagggcctttttttttttttgagagacggggtctcactatgttgcccaagcctgtcttaaacttctggacttatgtgatcatgacacaacatggttaccaggttctgaaatgttcatggctcagatgcacctccaagcctttgcacctattggttcctctacctgtattactctacctggggtgaagcctgtaatacacagcatttacctgagctaggtccctcagtgtggctgctgccatcaactgtgggtggagtaggcatcaccccagccagtgcctatgagcctcagacctgccacttgggagcagagatgactactcctcttgtgccttctcagtcccaacccagtactccctggcctgacaagcatgcccagaaatccctcatcctgggccttgcaactagcaccttctgggtaaagtacttctcagagctctcagccaacaatggtggtatcctccaagagcaaaccgaatgcagaccatgttacactctgagggctgctggaaagccctgctcacacctcaagggaggaagactattgattctttgtaaaagcgtcaaataggtatcacataagactctaggaagctcatcctgcacccagagaataaaaaaactatttgagatgctcccaaactttacttatctaagtggccatatcattggcatcattcagacttacaatgtgtgcactcagagctgagaacattaagtattgattgctctttaaattcatgttacccaaattattacagtcagttttgtgagtttcattgttttgttgggaacgaaagaaaattgtccataagacataatgacaggatgggtacaaaaaacagttagaaaaaatgaataagacctagtatttgctaccataacagggtggctgtagtcaaaataatttaatcatacatatgaaaatcactaaaagggtataattggattgtttataatacaaaggataaatgcttgaggtgatggagacaccattaaccctgatgtgattattacatatggcatgactacatcaaaatatctcatgtaatctacaaatatatacactattatatacccac

SEQ ID NO: 108676 - DNA, 2379 bp, Homo sapiens
gtcgaggtgggtagatcacctgagatcaggagttcaagaccagcctgaccaacatggtgaaaccccatctctactaaaaatacaaaaattagccaggcatggtggcgggctaatcccagctactcgggaggctgaggcaggagaatcacctgaacctgggagacagaatttgcagtgagctgagatggcacaactgtactccagcctcagcaacaagagcaaaactccgtctcaaaaaaaaaaaacaaaaaaaaaccaggggtcacatcattgacccttctctctctctccctcacctacaacatgcaaagatctacttgttcctttattaaaaatataggtagaatgtctccttttctcccatctgcacggcattcacctgggcgatcaactcatctgaattatgctggtaaacttccctccgtgctaactgcctcctcattaatccaggagtctgttctcctccagtgtgcaaccagatagatcctatgaacatctggattagaccacctctttccccatccaagcatcccagcatctccaaaacagatgcccagcttttcaggcaaccacattacaggcctgaatcttgacccggcttcttgttcctatgagaaagaatagatgcctgtcgtacataggtcccagctcagtcacacctcaaagcatttgcacaaaatggtatgaattcctaaaatagctttctacacctgtttccattggttgccagaaataagaacacttctattaatccttggctggtactcaggactctgagcttggtgtatccacaggttctccacgccaagaactgggaaaacatcaagtgaacactcaagacaccataatctcagacaccacacaggtagtgtcaggttcagggagagactgggacactttctctttccctgtgttggcaccataagcattttcagtgttcagaacccatgaaaataaggcaactgtgaccagctccagctgatcaaacctccattgatccctacacaaccgtaaagccaggggccctggggctaactaattaactgatttcaatcctcagtgctccttcttaccacctatggcctagaaagaagactccacttctcagtgcctcattgtcctcatcatccttattccagtctgttctctgagaggcttttgtaaacttttaaagttctaccaaggacatgaccctcttctgttcacaaatctccatacatcccaggacactcagattgaaggcacaacccctaagacaaccaatacaggtgtgactctggctcatcttcagtttttactagggcctttttttttttttgagagacggggtctcactatgttgcccaagcctgtcttaaacttctggacttatgtgatcatgacacaacatggttaccaggttctgaaatgttcatggctcagatgcacctccaagcctttgcacctattggttcctctacctgtattactctacctggggtgaagcctgtaatacacagcatttacctgagctaggtccctcagtgtggctgctgccatcaactgtgggtggagtaggcatcaccccagccagtgcctatgagcctcagacctgccacttgggagcagagatgactactcctcttgtgccttctcagtcccaacccagtactccctggcctgacaagcatgcccagaaatccctcatcctgggccttgcaactagcaccttctgggtaaagtacttctcagagctctcagccaacaatggtggtatcctccaagagcaaaccgaatgcagaccatgttacactctgagggctgctggaaagccctgctcacacctcaagggaggaagactattgattctttgtaaaagcgtcaaataggtatcacataagactctaggaagctcatcctgcacccagagaataaaaaaactatttgagatgctcccaaactttacttatctaagtggccatatcattggcatcattcagacttacaatgtgtgcactcagagctgagaacattaagtattgattgctctttaaattcatgttacccaaattattacagtcagttttgtgagtttcattgttttgttgggaacgaaagaaaattgtccataagacataatgacaggatgggtacaaaaaacagttagaaaaaatgaataagacctagtatttgctaccataacagggtggctgtagtcaaaataatttaatcatacatatgaaaatcactaaaagggtataattggattgtttataatacaaaggataaatgcttgaggtgatggagacaccattaaccctgatgtgattattacatatggcatgactacatcaaaatatctcatgtaatctacaaatatatacactattatatacccac

SEQ ID NO: 108677 - DNA, 2030 bp, Homo sapiens
gcttgagggcggactttggaggatcccccggttgggggacaacgcatgaggagcatactgaggcgcttacgtacgcgcttgctgcctactgagtaatacatatgcttgaagtcattcagcgcacagccagatagatcctatgaacatctggattagaccacctctttccccatccaagcatcccagcatctccaaaacagatgcccagcttttcaggcaaccacattacaggcctgaatcttgacccggcttcttgttcctatgagaaagaatagatgcctgtcgtacataggtcccagctcagtcacacctcaaagcatttgcacaaaatggtatgaattcctaaaatagctttctacacctgtttccattggttgccagaaataagaacacttctattaatccttggctggtactcaggactctgagcttggtgtatccacaggttctccacgccaagaactgggaaaacatcaagtgaacactcaagacaccataatctcagacaccacacaggtagtgtcaggttcagggagagactgggacactttctctttccctgtgttggcaccataagcattttcagtgttcagaacccatgaaaataaggcaactgtgaccagctccagctgatcaaacctccattgatccctacacaaccgtaaagccaggggccctggggctaactaattaactgatttcaatcctcagtgctccttcttaccacctatggcctagaaagaagactccacttctcagtgcctcattgtcctcatcatccttattccagtctgttctctgagaggcttttgtaaacttttaaagttctaccaaggacatgaccctcttctgttcacaaatctccatacatcccaggacactcagattgaaggcacaacccctaagacaaccaatacaggtgtgactctggctcatcttcagtttttactagggcctttttttttttttgagagacggggtctcactatgttgcccaagcctgtcttaaacttctggacttatgtgatcatgacacaacatggttaccaggttctgaaatgttcatggctcagatgcacctccaagcctttgcacctattggttcctctacctgtattactctacctggggtgaagcctgtaatacacagcatttacctgagctaggtccctcagtgtggctgctgccatcaactgtgggtggagtaggcatcaccccagccagtgcctatgagcctcagacctgccacttgggagcagagatgactactcctcttgtgccttctcagtcccaacccagtactccctggcctgacaagcatgcccagaaatccctcatcctgggccttgcaactagcaccttctgggtaaagtacttctcagagctctcagccaacaatggtggtatcctccaagagcaaaccgaatgcagaccatgttacactctgagggctgctggaaagccctgctcacacctcaagggaggaagactattgattctttgtaaaagcgtcaaataggtatcacataagactctaggaagctcatcctgcacccagagaataaaaaaactatttgagatgctcccaaactttacttatctaagtggccatatcattggcatcattcagacttacaatgtgtgcactcagagctgagaacattaagtattgattgctctttaaattcatgttacccaaattattacagtcagttttgtgagtttcattgttttgttgggaacgaaagaaaattgtccataagacataatgacaggatgggtacaaaaaacagttagaaaaaatgaataagacctagtatttgctaccataacagggtggctgtagtcaaaataatttaatcatacatatgaaaatcactaaaagggtataattggattgtttataatacaaaggataaatgcttgaggtgatggagacaccattaaccctgatgtgattattacatatggcatgactacatcaaaatatctcatgtaatctacaaatatatacactattatatacccac

SEQ ID NO: 108678 - DNA, 252 bp, Homo sapiens
gcctacccactctatttgtagcatttaatggtttagaaagcacattcatataagttatttcaaaagaaagtcagcttgtgaactacagaattgtatactttggtggattttatcacaattttaaaaaaaggagggcatagtaaaaattactattcatattctacagtaaaggaaatttctgctcaaaaacatcaaatggcttgcccaaggccataccagtattaaatgatagagcatggcccccagcccagg

SEQ ID NO: 108679 - DNA, 267 bp, Homo sapiens
cttgataactagacacagcttgctaattgggaaccaatcctcgtgaccacgttatagaagaattttagagaaactggttgggggatttgacatttacactcctcccagccccccacaaacacacatgacatagttggcttctttatttccacctttcagggctctcatcctcattcctgcttgggaggcaagcttatctgagtcttctacatcatgttaatccaaacacagattcctccatcctcagtttttagttaagacttgact

SEQ ID NO: 108680 - DNA, 659 bp, Homo sapiens
gggactcgttttatgcagatgccaaggatgcctgtgcacaccagtgatgttcttgttggagggcggatgtatagaggaaggggtcctacacgcggtctcctctcttcttcttctgggccttcccttccttggcctgcttgggctcttccctagtttgccaaagaaagagtatcttaggtatcttaggacctttttagtaccagcatcctatggcttggtggtggctaacacttgccattggaaggtcggtctattttagaaatggaagaggagagtcaggtgcggtggctcatacctgtaatcccaaaactttggggggtgctgagacaggaggattgcttgagctcaggagttcaataccagcctgggcgacatagtgagatctcatctctaaaaaagaaaaaaattggaaatggaagaggagaaaccaaggtaatcttttaaatgcctacctatgacaggaatcagctgaaatggtgtttagattgttaacaaatcctcattaataatcacacactaggttgaaagttgtattttaaagagtcacttgtgtgacattgtggcaagagagtgtcccatagcaacttaagtgtaattttgtttgtccctcagattgcaaacactgccttttactctcttcactccccattttatcagga

SEQ ID NO: 108681 - DNA, 861 bp, Homo sapiens
  misc_feature (457)..(457): n is a, c, g, or t
  misc_feature (523)..(523): n is a, c, g, or t
  misc_feature (556)..(556): n is a, c, g, or t
  misc_feature (571)..(571): n is a, c, g, or t
  misc_feature (603)..(603): n is a, c, g, or t
  misc_feature (611)..(611): n is a, c, g, or t
tgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggttacattagttatacactctggaggtgactagacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtaacatcacatgatcgttcaaaaaataatcatccaagtccaggatgcagcatctgtctcagtttanggcataggatgacagtctgaaatacacttactgaatttgaataagaacgggctcaggtcagtgatnatcgctagtgccttatcaacgccctgtggcttntcagcattagtcccnatatcctcgtccgttgtggcactgagagcagntaactgtngccctcgtaggttcccagttggcttccgtgactggtcagggtcaggtccactgcaacaggctggctgtgaatcccttggagaaacacagacattctgaccctaagattatgcttacaaatgccaatgtggtaaacttattcacaaaaaatcctcgatcatcaaaggtgtcgtgctattcgttaatgagaatattccattgcattggaatcagcattgcctccacaagttacattggaccaagatctacta

SEQ ID NO: 108682 - DNA, 865 bp, Homo sapiens
tgccagtgtctccgccggttgaaagcgcgtgtctgcgtcgggttctgttggagtgcgttcggtgcgccgtgggtccgcgctgcttccacccaacttcctgttagtttctctcctgtcacaatggcatgatctcggctcactgcgacctctgcttcctgggttcaaggattctcctgcctcagcctcccaagtagctgggattacaggttacattagttatacactctggaggtgactagacctgtcattgtgaacaattattgctcttggacgacccaggacataggccagccagtacttaccccagtgtgttggagaatcgcgctcggcttcttcctctgtgctgagtcatgaaagttgccggagcaggtgcagttacacaacctccaggtatgatcctgtcatacaggactggatactaggataacatactttagaggttaaaagtacaaaaggggtgtatggcatgagggctggagtgatactgggacacaagagacatctaggcttgctgtcaaggctactgctcaacatgagatgaacgacgaatgatgataaactgatgaaccccggacagcctagcatcacacactgaccaagaacacagaacgaactggcaacaccgacgaagccccggagacctgaaacaacaagcagacagaaacaacaggcaggaaaaactgagcaaaaccagaacagcatgaaaggcgcagcagcaccaacgaggaggtacaccggcaggcaacacagacagtaatacacacagcagaagccgcgagcggaacaaagaagaacccgaaagcacgaacagcagagaagaacaaaaggaaaaccaggaccgaaaaccaaaaaagaaaaagagaca

SEQ ID NO: 108683 - DNA, 480 bp, Homo sapiens
tcttccccctccaactagaaagtagctaaacaactggagagaattggccttgggcaagcagctaggagaggacccgttgctcctccctgcctctatattgtgtaagtttatcccgacatttaaaacttagagctgggtgtggtggcacacacctatagttctagctgcttggggggctgaggcaggagaatcacttgaggccagaagttggaggttacaatgagctatgatcacactactgcactctagcctgggtgacacagcaagactctgtttctaaaataaattttttttaaaaaaaattggagatttcacattaaaactctcatgaaaaaccagcagtggtcatatggaggtcaggcatcttttcagggcagggtgtcttctccttctggtttaaagcaggagaggccctgagagaagagccttgggatgggatcttctagagccacagaatagtgaaaaatacgcctcttgaac

SEQ ID NO: 108684 - DNA, 646 bp, Homo sapiens
ctgtctggtggtataaaggttattaatcttaggtgcatacaaattggccctggttcttaatctaaaggcttccagagaattgtttcttaaagcttggttcatcaaatgctaatagtttttacccatgtgaacaatacaaaaaatgttctcaaaaataagaagagtaggaaattcaaggttaaactaagtgaaatagtattcttcattgctgaacttctcagagtcttagatttacctatttggatgtctatggagtaataggcagaatttccccaaactacttgctgactgacctgttttttgtggagcacattgtggaagtaatgattaaatgcccctttcctgcagacttttccactggagaaagtagaggcaagcagtctgatggctgctctgtctgagccacagtagctgaaattaatggttccagcatcagacaagcacttgggcctctagcaaaggaaggaaagactgatccacactgctctgccacattacagtgatggtcctgatagccaagagaactgatgtgaataaaaacataaaaatgcttacttttgtgggttaggaatctagacttttcatatatatggaaaatgaactggaaggtgacacctttacttttatatttctgcattgagacaaa

SEQ ID NO: 108685 - DNA, 442 bp, Homo sapiens
aaacccctgggctcaagagatcctcctgcctcagcctactaagttgttggggtttatatttttgtttacttctttttggtctgtttcctccccaaggagaacacaaatcccgggagaacagagaccccatcagtcttgtttacctctgtatttccagtatttagaacagtgcttggcacacagtgaaagctcaataaatggatgaattaatcaacaatataggcactcgagatgatcttccatcatctcaccatctcaagtcagtgagacacaaatgctttgtgattggtgccatcgtttaccggattaaaaccacagtccccgtggtttttcttctttatgctgtctttatttcagtcagtcaagtccattcatttgctcttctctgctgccccctgtttttctttcacatctttatcaaagccctctaagcctgaacccc

SEQ ID NO: 108686 - DNA, 778 bp, Homo sapiens
gtctcacttgggccaaggagttctcgggcttcctcgtggtcgcgcagcccaggtcaccggggcgcggcttggaaggaaggggccgccaagctgggacttagagagtctgaggttttcgggaagggtcctatcagtgactgaggggagcaaaagtaaccggaaagaaaggaaagaagaaacggtcagagcctgctccgcgcgcacttcaaagccgaggcgcccgcgtgggggatgcacgggcccagccgccagccctgggtcccggcttctatccaccgggtgtgacccggctgggcggcctgcttgggacccagggcggtgacaggggaaaggccgagggaggagagagcgggccccggaggggacgcacgaccggaatcttggcgaggggcttcctccggagccccagcccagaggggggccagcgctccctccccgccgtctccctccggtccctcccctgcccgcgggccgggcgactcttcgccggccgccttttccgcgcgccgcagactgagcccgctgctttgctcgcaagtcagtcgcaaagcgtggcgttccgagaggcgctgaaactttcctccaaatagctgcggccaataggccgtggtgaacagagcctggcccccggctgcttcccggccctcctccctggggaaagaacggccaacttgaacccctccggtggcagaagagggaggggtggtggtggttggggagacgggcgaaccgcactaacttgtgcctttgaatctttcctttcctgaaagagcagcgc

SEQ ID NO: 108687 - DNA, 359 bp, Homo sapiens
ctcaccatcactgcagaacaagaccctgtctcaaaaaagaaagaaagaaagaatatttagaccagtttctccctgaacacatatgatatgtcaggccctgtgccgaatgcactgcagacctcattaatgctcatcccaatggactaggtgagtagtattgtaagcattctacagataaactggggctctgagagattaagatcttgccccaaatcacagaatagtagcggtgacccgggaatgggagtcacggccctctgacgttgaaggctttgccttcccagcagtgatctgggactgggagtcacggccctctgacgttgaacgctctgccttcccagcagtgatctgggaatggg

SEQ ID NO: 108688 - DNA, 366 bp, Homo sapiens
gctgtgggctcatatgtggagcttccccatccgagtctcccaacaaaagcaggagggaggaattgctgcccctccccctccctgcctacagcagcatttctaatcattaacatcccccacccctctgactctgaccattacctgggtctgtgaccatctcacagatgagaaagcagaatgccaaccttcctcactgatgtatcaatataatatggatagatgcaggattaaaacattggtgatatatgatgattagagcctgttcagcagcatgagaagcttagaggtaaagagcttggagtctggactcatgttcaaatctaggcctcaccaggtactcaaggtacaaccttgggaaagacattt

SEQ ID NO: 108689 - DNA, 313 bp, Homo sapiens
gtagctgggactataggcatgtaccaccacacctggctaggtttgttgttgttgttgaggcagggtctcactatgttgcccaggctggtctcaaactcctgagctcaggcaatcctcccacctcagcctccgaaagtgctgggatcacaggcatgaaccactcactcacatgcccagatcacctgttttattttttaccttatacctatcacaagctgacattcattcttacttaattacttatatatagcctgtatgcctctccaaatctaaaatgtaagcttcccaacctcagggatattgcactgttctt

SEQ ID NO: 108690 - DNA, 291 bp, Homo sapiens
ttgatccattcttctattgatggatatctgagctgtttccaggttttggctagtatgaataaagccaaagagagccattttaatctggggcatttaaaaaatggtgtgaataaactttcatctgaacacagggttccgtggtaataatttttgaaaatatcacctccagctctgacgtgccgagtttgtaattttcgtaaatgatataagaagtcatttcttcatccattcatttgttcactcaacccttatttagtgggcctattccctgtgccaggaatcattcaaggc

SEQ ID NO: 108691 - DNA, 422 bp, Homo sapiens
cggggagtcatctagaggatcccgataagagcataccctggcagggggctgcagtgtaggtagttctgtggtagggagtggtgcgtttggtgggttaaagggctgcaggctggggacaggtggcaggggactgagctggagtacctgtttcctatgtgttctcttcacatccctgtgcccactgaggacacagctggcaaccagaccaacagggtgcctgcctaagatggcttagcctgatgggggagacagatggcaaatagaagattacaactctgtgccaccatcagggagaaggcagcggaggaggtgcctcctgccagtggatgggagtgggcaggcgggtcagggaagcttggagtccgctgggccacagtgctttggggagagggggaggagccagcacgatgtccccatgtgtc

SEQ ID NO: 108692 - DNA, 327 bp, Homo sapiens
aaaaaataaaataaagataaagaagcacatgcttactaagagcctttagcacaatcttcacgtaaacatatgtactttccattgtactacccaaacctaaatttagaaacaggattagaaaaatatcattcctattcttcttggctataaatttacccatacaaagttaaatttaattatacattcttaatagtcttggatagacagggcttcacagataaattgtaatttaagcaagaattattttttcctgtttaaccctaaacacaataatgtggtctttactagctcatctcaattgaatatcatgccttagtatttgggctt

SEQ ID NO: 108693 - DNA, 358 bp, Homo sapiens
cctgcagtaggtgtttagtgtactttgagtgaatgagtggataatgtccgtggggcagcttggtccatctttgcaaatgcagaagcgatcgtctcccctgttcctctggagtttgcctgacgattgcaaagaaagtggcttccattctgttgaataatgagaataatcatgtttttaaaagctacttattaagagctctcttgtttaatgaaaaacattgtttggctttcttaagatccaattgtgatgcagatctctcaacctgcagctggtctctctctttatgtaacagcccatctgggttgtgctcaaggaaaccatattctaaatggaattctttaaggccttttcaaatcaa

SEQ ID NO: 108694 - DNA, 758 bp, Homo sapiens
acgccattctcctgcctcagcctccggagtagctgggactacaggcgcccgccaccacgcccggctagttttgtttttgtatgtttagtagagacggggattcaccgtgttagccaagatggtctcgatctcctgacctcatgatccgcccgcctcggcctcccaaagtgctgggattacaggcgtgagccaccgcgcctcgctgtccgcctcttgaagagtaaacgaggccgggcgcggtggtttagtaataccagctgtaatcccagctacttgggaggctgaggcagaagaatcgcttgaacccgggaggcggaggttgaggtgagaggagatcgcgccattgcactccagcctgggcaacaagggcgaagttctctcaaaagaaaaaaaaaatcgtcggtttccttttcccatctttctttcgtgacttatattccagaacgaagccccacacatcattaatgatttgaatcgtttctaaagtgtttcttaaatcgtttcttaaatcgtttgttgtttcttgtctaacagtccagaacacatattacataatggagccgggagacagactagggctggcttgatccggccacgcagtccaggaaaggtgcttttcacccccaagtgcaaaatgatcaatgtattcttccgatctacataaacaagcacctcctggtttcattttcgtaaagcaaaacaagcatggaagctttactgtttcggctcttcaaacttccagcaactacactgcgctg

SEQ ID NO: 108695 - DNA, 329 bp, Homo sapiens
atagatagcatcagaagacctaagagaaagcatatcttggtttagtcttgtgtttttgttttagttttagacacagggtgttggtatgttgcccaggctggaacgcagtagctaatctcaggcgcgaccccactactgatcagtatgggagttttgaactgctccgtttctgacctgagccagttcactcctccttaggtaacctggtggtctcctgcacttgggaggttaccatattgatgtctaccattgtgcagatacccaattggcatagctagcacactatagcccagaactcctgggctcaagtgatcctcctgcctcagcct

SEQ ID NO: 108696 - DNA, 747 bp, Homo sapiens
ggacaatctatcagaggctgatcattccaaggacctgatttatccatgttatggaacacaaaagtcaaacagatttcctcagcctcacaaggttccaattttctacgagcagcagcaaagaaaaagaaatgacttgcagtctaaagcctggagtattcagtgtagtattcaggagatgggctaatccacggagccctggggacagtgcagattattgtcacatgccaagaaaatatgctagctctcttctgaagctttaccattaagactaccttacactataaaatacaacatattattagagatgtaaccccaattggtgtaaatgtgaagaaaatctgtctgtatgccaaatgcctaaaatgacttttagattaataatgcacatttgaaatgataggcaaatcattcatcattctcaaacactaccacttttattccaaagtgtcctatgagtgcatttcctggtatatatatatattttttctctaaattcctttgttttcctatatagtcaccatctatgcattgttctgaaagctattacatattttaccatcaaccatctgtgcttctacatgatttatttttactagaagcagttttgtcaaaaaatttttatcatgttctatggtatgtcattgtggtttggcatcataaaatgtagcctctacatttatcaacctcagatacctgttgaccacaaagataggtctactatgaaaactctgtttcacaaaaagaaaa

SEQ ID NO: 108697 - DNA, 486 bp, Homo sapiens
tgatggggagagggagaaggggagagggtgatggggagaaggtgatagtgagagggcactggagagagggaggaaggatgcttcctggcatttcctgaggaggtcagggactccgagctctccccaaacattccctgtctctttccctcattcatagccctggagacacgaatgtctctcaaacagtcgggaaaggaataattgctgtagactcagtagaaaaggaaaaaaactagaaaactagaagaagtgaacaaaggaaggagatagaggtgagagagagggagtttcttccatgagaaccatagccatggcggctcggtcacttggcgtcagaaggtagcacagcagcctggggcagaggagccaccagctcctttatggaacatggaaggctttatgaccttaaaggttagagaggggctgccaaagggcaccctgaagggagatttagggccaaggatggagggaagtctgagatcagcc

SEQ ID NO: 108698 - DNA, 650 bp, Homo sapiens
aggatgccaaagatagaggtttgagtcagcttgacactggcttaggcgctccttttcactctccttgttccttcttccctttcccctcccccgctggccagttgtttcctgggctttgtctgagatacactgtacagttttagtcccagtctactagcgcctgctgaaaaacagtcagaagtgagatggaggagaagctgccaggaagtttctgacaacactaagctccggcctctgcctctgctgatagtacaggacaacagtaacctcaggagaaaggcatccagaggcctgcgctgagcttgtggctaactcaagggaggagaaaggacgggcctggaaatgcccctcttagattcatcttatttaccaccaaccatctttattttgactcacgttcttggagttgctggtgttctatactggaagaggcatgccagaggtagagcaggtaactaactggtacccagttattctttaaatctactgtggggcttttgagggtggggtgaatgatggaggtcttcccagttgctttccttaaagggccagtacgtccttcagctggggtgctgtcagacttaagagtgtgtgtgtgtgagtataatgaagaagctggtctgccctggggccactttgggatgggggtg

SEQ ID NO: 108699 - DNA, 342 bp, Homo sapiens
ctcctgagtagctgggattacaggcacacgccatcacgcccggctaattttgtatttttagtagagatggggtttctccatgttggtcaggctggtctcgaactcctgactttaggtgatccacccgcctgggcttcccaaagtgctgggattacaggcgtgagccactgcacccagcccagaacactttcttgatacgttttggaagtaaagcccaattgttgctattctacaacaaatgacttatccatcataattatttgacttttctgatgaggtcaataccactagtgcaatatattaacgtttttaaaaaatcaagtcagtgttttatttttcata

SEQ ID NO: 108700 - DNA, 495 bp, Homo sapiens
  misc_feature (419)..(419): n is a, c, g, or t
tggctattactattatcccaaccccagaggttgttctgggcacaagaagcacctgatatactgttttggagactccccaaattggggtggctgcaaggtgaggaggcagcagtcacatgtaactgtgccatgaattcagatgtcaggttaaccgggtctcttcctaaaggaaccaaaccaagaattttttcctttgatgtctcaccatgatttgaaactgagtcaatgtctttgctaaaagcaatcttttttttttttttccttttaaggggacattcctccaagggtgggctggtaaaggggatagccaacccaacgggtggtccaattggatatactcatttaaccaacattagggtaccaagggtgttaataactttccaaagaggtcatcaattcaataaaggtccagacttggncaggaagggctagccggtaattccaagaatttctcttggaaccccaatgttttacagggcaggattgtaccctcta

SEQ ID NO: 108701 - DNA, 113 bp, Homo sapiens
ctgagttttcttccatcttatctaatacaccctctgaaaagaaggatcttttttagttctgctaagatccccaaatgctcttaacatctccaaagctctctaatacaaaagga

SEQ ID NO: 108702 - DNA, 614 bp, Homo sapiens
tcttccttcttctgatgctcgtcatctgatgtgcgtgtggaacggtgtctccgtgtggctgatgctcgtcatctgatgtgcgtgtggaacagtgtctccgtgtgacaagtgatgtcgagcatcttctcgtgctttttggccatgtgaatagcttcgttggagaaatgtctattcaagtcctttgaccatttttgaattgagttttttttttgttttttttttttagttttagaagttctatatatattctggatattaatcctttatcagatatatgcaaatattttctttgggttatctttttacataaaaaattttttttagatgtagggtcttgcagtacagtgatcatagcttccctgtaaccttgaactccctgggctcaagtgatcctcccacctcagcctcctgagtagctaagactgcaggcatgcgccaccacatctctacaaaaaatacaaaaattagccaggcatggtggcagcgcctgtaatcccagctacttgggaggctgaggcaggagaatcacttgaacctgggaggcggaggttgcagtgagccaagatcacaccactgcactccagcctgggtgacagagcgagattctgtttcaa

SEQ ID NO: 108703 - DNA, 282 bp, Homo sapiens
tttaagtgaaattcaagccactgatttccagagtctaagtcaccagctggttttacaaatagacatgcaaggtcctagaatcttccagctgtttgccttaaaagacaggacaccagatttcttttatgaggcaacccttgagcccctacaggcctagctttggaaggaaggaaagatttaggctgcttaagtcttattgcagccactcatggctaccatagacagttgtgcagcctgcgcactacacaaatgcctctgggatgtcagggggagcgaacatgg

SEQ ID NO: 108704 - DNA, 401 bp, Homo sapiens
taaagatggagtctcactctgtcaccagcctggagtgcagtggcgcaatctcagctcactgcaacctccgcctcctgggttcaagcaattgtcctgcctcagcctccccaactagctgggactacacgcacacgccactacacctggctaattttgtatttttagtagagacaggtttctccatgttgaccagatctcgaactcctgacctcaggtgatctgcccgccttggcctcccaaggtgctggaattacaggcttgacccaccgctcccagcctgttttctattcttgaccaaaaaatagaaccatctaaacaagttgtctataacagagatttctgggttgcataattattcaatgaattagtttctcagggagaaacccacattttcccaaaag

SEQ ID NO: 108705 - DNA, 359 bp, Homo sapiens
aactcctctaatatgaaccccaagttcttagaacagtttctatccatagtaggtgctcaataaatatttgctgagggccaggcacagtggttcatgcctataatcccagcactttgggaggccaaggcaggcggatcacctgaggtcaggagttcgagaccagcattaccaacatggtgaaaccctgcctctactaaaaatacaaaaattagcagagcatggcggcaggagcttgtaatcccagctacttgggaggctgaggcaggagaattgcttgaatctgggaggtggaggttacagtgagcctagattgtgccattgcactccagcctgggtgacaaaagtgaaactccatctca

SEQ ID NO: 108706 - DNA, 549 bp, Homo sapiens
tcatactttagtagtaaaggctacattaaagtaaaggactttaaataattatccacaaataatttaactgcatgacaaaatgaacttcaacagtctttgaagagaggacagcaaattccaaacactcaacaatataatgattataatatctggcatacaaaaaattactagacatttcaagagggaatacaatgtgacccataaccagaaggaagccaatccgtagaaacagaaccagaaatgatggttatagaattagcagacaaggactttaaaacagctattaaaatgtgttgaaggattgaaaggaaaacatgaatatagtgagtaaagaagtgaaagacatataaagaaccaaatggaacttctggagctgaaaagtatactataaaaaatgaaaaattcattgaagaaataaatagcaaattagatgctgcagaggaaaatatcaatgaatttgtatccataacaatagaaattatccaatctgaaacagaatagaaaaaatggaaggaaaaaagcctcagtgaactgtgagacaatatcaag

SEQ ID NO: 108707 - DNA, 707 bp, Homo sapiens
tagatgaaacttgaagacattatgtgaagtaaaataagccagtcataaaaggacagatattgtatgattccacttataatttccttccagttattcattactattatagaagtagaattcatttttgtatatttaccctgtaacctgcaacttgttatatcacttattggttctagttgatatttttggagtttctttaggactttctaagtacccaaagttgcatgtttcattctctagtaaatactgttttacttcttcctttacagtgtttacctttcatgcagtacaaggctgaattagagtgatgagagtggatacccttgccttgttcacaaccttgtggtggaaaacattctggtccctcactgttctgtatgacatttgtgctaggtgttctgtctatgccctttgtcaggctaaagaagtttccttctatcgctagttggctgaacatttttataatgagtggatgttggattttatatttaaagttttactgcattccttggtaggattatatgttttttctcctatatcctgttgatatggtaaattacattgattagtttttgaatgttggcctgactgtaaattagtggaataaaacccacttgatcatggtataggacccattttatataattgttagatttgacttgctaaattttgttaaggattctttccatctatgttcataagaatat

SEQ ID NO: 108708 - DNA, 714 bp, Homo sapiens
tatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagc

SEQ ID NO: 108709 - DNA, 318 bp, Homo sapiens
aatgtttattcaaggcccaaggccacattagtcagcagatggtgaatcctgccaggaccaagtccgtaccaaccgggcagtggattcccttctgacccaggatgggcctagaaacactatccaggaacaaagcctggaatcgggggcttcgggaatctgtttgatgttttatcgtattgtggctaagctgatacccaagttgcaagacaaagtcctctgtgctcttctctcttctttccccaagcagaaggaatctctccccaagcatcagtacctgaagtttgggaaggagtgacatacatactcctgtggctgcca

SEQ ID NO: 108710 - DNA, 594 bp, Homo sapiens
ggaaaatataatctgtcacaccatggctgagtccagattttaatcagccaatttagcacactattaatttgactcctaggaactaaagccaacacattaaatccagaatcctgaatgagtccttctacattaataaatttaagcaaaagagctttcaatgatgttctttttggtctaacacctttagaatccacgctcacgtatgctccccaaacttccatcaacactgatcagcgtcataactctgcgcataggctctctctccaaccaccaggctttgtacctctccatctgggctcttttgggttttaactcttgttataggcctagaggtgatgagtggtaccattagcatgggaggcaactgccaggtgttcccatttaaaagacttcttgcagagaacagtttgtttctgtgctagcgagagagttaagaggaatttacaggtcccaagttctcaactttgtccatatctgcccaaatgtcctcatcccatggctcatgcctaaatcaagccaaccagtgtctctaccctagggtaagaagtatagcaggttttagcctttaactggtgcagaaatgtttcccccttg

SEQ ID NO: 108711 - DNA, 210 bp, Homo sapiens
aggggctgggggagttgggggaaacatgagactgggtttgtagggcccctaaggaggagctcaggacccggtccaggtgggtacgagtcctaggttcctttgccccaagaggggggtctggggcagtggcacgttcaggacccttcctcagtccctcactggaatgtcctgggcatcggcacaacttcgggtgagcttgctccaccagct

SEQ ID NO: 108712 - DNA, 325 bp, Homo sapiens
ctctgtttttgtctgtctcccccatctctgtctctctgtctccctctgtctctgtctctctgtctctgtctccttctgtctctgtcactgtctctccgtctcttcctccctccatctctgactctgtctgcctgcgtctgtctctctctgtctccctttgtctctctgtctctgactgtctctgtctctctgtctctgtccctctgatgtctgacccaggtgggcagtacctgtggtggttctgctgtccctgaaggaatgacatgttctcgctctgcctgagagacctcctttgcctcctctggagggtctgagaagacaggag

SEQ ID NO: 108713 - DNA, 384 bp, Homo sapiens
tgctgggatgggggtggcgcagagtgagattggtaggctcgtaggtccctgtcttggagatacctacatgttgcttgagtgactgaggaaaaatgttcaagcttttaatctgggaaaacagttatgataaaatatatgttggggctgtttcctccctgctccccacttcctaccctcttacgtccacacgcttggtagaaggtctaggattgtgactaatcactgcccccattctgaagaaattgtacttggccatctctatgggactgggcatcctgtgtgagcgtctgctcgattgttagctgacacacaatcatttcttcccttttgttttctatcgggtctgtcttgctctgagagtgtacccacctccttccctcccct

SEQ ID NO: 108714 - DNA, 684 bp, Homo sapiens
cactgattaaaaagtaataaagattcccctaccagtacggagtgaaattgtgataactcctggcacaaccattaagaccctcatctatagtggactggaacaaagcacaggtaaaaggatatctttggattgtgcttttgaacaattttgtgtttgccttactttaccgttttgataactttgttaactattgctaatttgttaacttctcttattttagaacttataaaaaagaaaaaagtgcacattcagtttaatgaggtgttaattcaaggaatgctgtgagagtcagaagttctaaatgccagtgtttaaaaagatccatgtcacagtgatcttgggtaggctgggacacaccagctcactgacggacctgaaaatggattgctgtgggactacaaccctactcaggatattctgagttataagtggtatgcttggttgttttgtcttacgtacagggaggagtcacctaaggtaaaaaaaaatatatgtataaatgccttggaagggacaaatgactcaatgtttggtcagggttcttggaaggtttgacaaaatgagatcagagaataggaatatggatggatttacaggagcgagcaaaatatgtgtattttttgtgttttatattaatgcccagcaaacattactcactatacaggaagcacttaacaataagcc

SEQ ID NO: 108715 - DNA, 274 bp, Homo sapiens
taacagtataagaggtactttgtttaaaaatttagtgtgatctccagatacaactgtaactggagtcccagaattgattaagaccctgaagatttgccatttggtgcatcttggtagatgttaaaattaataaattaatttagaactgaggttgtagaggcacaaaagctaattaaagccctttttacctttcttttgcatagattgttttagtaaatgttggatttccaattgggtaaaaaaaatcataagcctctgctttagttattgtttc

SEQ ID NO: 108716 - DNA, 700 bp, Homo sapiens
tatttttaaaagaaattttatttcataactatacagggaaaattagcagaactgacgacagatagaaagtaaacatgaaaacaaatacgataggtacaaaacaaggttgtcgaattccagctcatttatttgacagcctcttaccctcacaaccatgctttgttatgaccattatctcattttaatcctaagtaaactgagtcccagagagatcaattgatgtgccaaagttcataaagcaaggcagggaatgtaccaccctagtttccagagttaaatgccaggctgagcctgtatttttgtcttttcctcatcctctatagtggagtcagcaaagtacagctcgtgggccaagtccagcccaacatctgtttttggaaataaagttttattggcacacagccactcttatttgttgacgtattgtctgtggcagcttctgtactataatggcagaattgagtaggtgctacagagaccatgtgaccctcaaagcctgaaatatttattatcaggccctttatagaaaaagtttgccaacccatgttctagatagaaaaaaaaatgaagtacatcaaagagaataagttatagttcatggaacacacataatgtctattcttcccatgactgcaacaaaatgtcagttaaagagaaataaatgttttttcaatgaatgatttaaaaaacaggagttaaa

SEQ ID NO: 108717 - DNA, 446 bp, Homo sapiens
atagattataagacattctttatgcgctgttaagaaagaaaagactgggccgggcgtggtaatcccagcactttgggaggcagaggtgggtggatcacgtgaggtcaggagttggaaaccagcctggccaacatgatgaaaccctgtatctactaaaaatacaaaaaaattagctggacatggtggtgcgcacctgtagtcccagctacttgggaggctgaggcaggagaattgcttgaacccaggagggggaggttgcagtaagccaagattgtgccactgcactccagcctgggcgacagagcaagactctgtctcaaaataaaaaaagatatatatcggctgtttggactctgggcactgtttggactctgggcactgtttggactctgggcactgtttggactctgggcactgtttggactctgggcactgtttggactctg

SEQ ID NO: 108718 - DNA, 450 bp, Homo sapiens
tgactacgtgcctctccaaggggttgagtattcagcatacttgaccaagaaagcttgcttccttgattacgtatttttgaaaacaggggcatgtgatttatgagacattgatttacaaaaatttaccaaaataaagatattacaatgattttcaataaagtcatgtgctgcataatgacatttcggtagatgacagaccacatatacaacgttgatgccctaagataatgatactgtatttttactgtaccttttctatgtttaaatacatttagatgtagacatacctcattttattgtgatttgctttactgtacttcacagatattgcattttacaaatcgaaggtctgcagcaaccctgcattgagcaagtctattggtgccatttttccaacagcacatgctcacttcatgtctttatgtcacattttggtaattctcgcaatat

SEQ ID NO: 108719 - DNA, 544 bp, Homo sapiens
tgatcctgagttaaaggcattactaagggaaccacatagggacagagtgaatgtcacttcttccattaagtttcatagtgtttgctgcccgcacatgcttgtacctgtcttgtcacttttcccttctgcctgggagatgggtcagtaaattccaaagggccttttgctaatctaacagccagaaaaccaagcaaaggcttctcccctactgatctccaagagcttagcaagaaaatgaaattcttgtggttctagggcacagctgtgataaccagggaccaacacccgcaagtgtgttgaaacaataggcctgaagtccaaaagctaaaagaataagtgttacaatccaagctcaggattcacaatgagttcgagatgaactctacattcagtttttggagaaaaacagttgtattaagtagtgactgagtatttaaggatgaagtattaagtttcaaaactgttcaatattatattaagtattaaaaactaaagtgaccttttaaatactgttgaattatgcctcctttcatagagttcttta

SEQ ID NO: 108720 - DNA, 872 bp, Homo sapiens
gggaatgatggtcagtttgtagtgacccactctagaggccagttcctctttaatcacccgcacatactttcaagatgactctctggagtccagggtgctgcttaatattggaatattgctgagctcacagtttattgagaagactgattctgaatttttggtctcttggcctggtgctggagccatctgagctatgcagcccgacactggagtaattggcatgtcctattaacacctaagcttttcctttatgagcaccctttggattgcaagccatcaagtttatctacctatcgactctttgcagaggtgtcacatggttcccagtttctgatcctgacctgcattctgaaaacaaaatgaggaacaaagaaagagaaaggatattcatttctttgggtacttcaaggttctaatgaatgaaacagaaatgctgccattaaaattccctgaagcaagacaacagtgagttttactagcacatcaccaaagaagttaatcaggtttccttggggttgctgggctacgttgctttgaagaaaaatagcacttccctgaagagtaagaatagctgaaaccacatgtcccagcgagctttcagccaactgctcctgaaggaaacggaatttaactgcgagaatggtttttgttggatgacgttttgattaagcaacaggctacttttccaccccgggaatgtgatcatttgaagatagatatattatgacccaaatagaagctggagtagaaggaagggcttgtaggctgaggttatgccttatttggtaaattactataagaaaattgaactgggtgagtttaatattcagtccttattttctgttccagacatcttgatatctctgtgagta

SEQ ID NO: 108721 - DNA, 307 bp, Homo sapiens
gggtgtccctcgccagccggccctctgggaacagggcgggggcgacaccccagggagtagggctgaggaccgcaaaaatcaatcgtgggtaccggcgcggggtcacgcataggagaggagcgggagaggggctggtgggggccccagggcggctgaggccgtggctctgtctgtggactcggcgggcgccccgaagtctggggccgccacggctccagctccgccggctccggccggagactccaggccgcagtttctcctcctcccggcgccttctctccagtgaggagctgagcgcgggcggcgc

SEQ ID NO: 108722 - DNA, 571 bp, Homo sapiens
ttcttcattcccagaactgttatgaggtaagttcagaaattgccagcttcctgatgctctatgctttgaacacacaaaataatcaaaggtgctctttagtaggatcctttccctatcaaaataacagtaacacccaatctgaggcctcaagcccactccttgagcaaaacaaaaagggacaggggagagtttgagacactggctacaccctgatccccaaatcagtggtttaaaaaaaatctcagactctttcttcaatcaggaagaatagatttcttttgtctctagaaatctcaggtcatccaagggacaacctgatagttgatttttaaatttagtgacaaaaaacttcagcaactgtcctgatagagtaacagctagtgataacaatgggtcagggattcatatatttcaaaattaactcaataaaaatgaaacgtttctgtctgtggagtctagatgtaaaaatggaaaactcatgcaattacgtatgtttcttacatcatttaagaattcaaagagttaaaaattaatttccattaagttaaactttccttctctgggtcttgtt

SEQ ID NO: 108723 - DNA, 542 bp, Homo sapiens
ttgtgtacaaatgtggggcattagtaagtgaggcattcataagttagaggcagccaatattggttagaagcagatacttaggatctctgagtctgctctgttaataaatgaagtagcaacaaagacaggagtaccacgcatcggagggtggaaatggcaaaaaaggaggcaccaatgcaaattctgtaagttgaacatgttgattgctgtctagtgctttgcaaaatgcaagtctgggcagggtgacctctggcttctttctcgaatattttataaaatagcagtatcatagccccaagcaagagcctgagttgcagccatctcagttcattgccttttaactccaaatctgccacttcacagatatcttgctcatcacccccttagcaatacaaagaccctaacacttgtgctttacgacagaccctgaacaaaggataacagctgctgagccacacggaatacttttccaagctgcagaatctcccaaggttggaacccaacaacatgcctaactttttcatcagtatctaaaaacaacc

SEQ ID NO: 108724 - DNA, 157 bp, Homo sapiens
tgtctttatttcccttcatttttgaaagatattgcactagatatagaattctaagttaacagttcttttctatcacttatttagaaacgctgggacacttcattctggcctccatcattcctgatgagaaatgcactgccgtttgaatatttcccct

SEQ ID NO: 108725 - DNA, 431 bp, Homo sapiens
ggtggctgaggaagcttggaggggaaaggcagctgaagtacaatatatgttctaccacggccccctggagccagcgactgggacgtgagacaagtgggcatggctccttttcaagccagagtctccaaaaccaatttcttaaagctagcctccagtggccagtgggtttcgggcagggaaggaggatgtctatactgcaggttgaagtttaatttatatttaggaactgtttgttttatttggttttgggttaaaggtggtaggtgccaagcaagactatccccctttcaacttctttttttaaaaaagacaaagaaaagagaaaaacaaaacaaccaaacacccgtagcccaaggccatgctgcgctgtgggcggcctacatgagcttcctttatccaaccacaaaaaggcatccgtggaaccagcgagg

SEQ ID NO: 108726 - DNA, 216 bp, Homo sapiens
tggttttgaggatttctgagatgattttgcctgattacattctgagaacttaaatctagcttcattaaggagacaactaactgctcatctgaatgttgtctatagcaagcagaccagcacagtctcaccaagaaagttgccttcatgcttaattttatgggtcaacttgactgggccatggtcccagatatttggtcaaaagttattctggatgtc

SEQ ID NO: 108727 - DNA, 790 bp, Homo sapiens
gacataacaagagtctatctctattttttagtattaaaaagaaaagtgggttttaactcaattggtagaaaaccaatttagtggcatgctaccaacaaaaaaagaaatttaaatagaatagaaaatataggctggggctgggcgtggtggctcatgcctgtaatcccagcactttgggaggctgaggagggtgtatcacttgaggtcaagagtttgagaccatcctggccaacatggtgaaaccccatctctactaaaaatacaaaaattagcttggcatggtggcatgcgcctgtagtcccagccactggcagggctgaggcaagagaatcgcttgaacctgggaggctgacgttgctgtgagccaagatggcgccactggagtggctgggtgcagaagttcacgcccgtaatgccagcttttagggaagcagaggcaggaggatagcttgagtccaggagttcaagacctgcctgaacaatataatgagaccccgttctccacaaaaaggagaaaatatatgttttttaatgaagtttatttatatataaaatatataaatatatacttgtatatatatggcaccacttagtaatggtaaatattgttttatcaacttttgctatattatatatacatatctattgggttccagttttaaaggtatttcttagtggagtcacagtcaaaacaaaattgagaaatagtgttctagatctcagagtatcctttagaatactagtcctctgataaatagagtttccctctataaaaagattctgagattga

SEQ ID NO: 108728 - DNA, 1401 bp, Homo sapiens
atggagccatggccctgctccccgggcggcggcggcgggacccgcgcccggcacgtcatcatcaacgtgggcggctgccgcgtgcgcctggcatgggccgcgctggcgcgatgccccctcgcgcgcctggagcgcctgcgcgcctgccgcggccacgacgacctgctgcgcgtgtgtgacgactacgacgtgagccgcgacgagttcttcttcgaccgcagcccgtgcgccttccgcgccatcgtggcgcttttgcgcgcagggaagctgcgactgctgcggggcccgtgcgcgctggccttccgcgacgagctggcctactggggcatcgacgaggcgcgcctggagcgctgctgcctgcgccgcctgcgccgccgcgaggaggaggcggccgaggcccgcgcggggccgacggagcgcggggcgcaggggagcccggcgcgcgccctgggacctcgggggcggctgcagcgcggccggcggcgcctgcgcgacgtggtggacaacccgcactcggggctggcgggcaagctcttcgcctgcgtgtccgtgtccttcgtggccgtcacggccgtgggcctctgcctgagcaccatgccggacatccgcgccgaggaggagcggggcgagtgctcccccaagtgccgcagcctgttcgtgctggagaccgtgtgcgtggcctggttctccttcgagttcctgctgcgctccctgcaggccgagagcaagtgcgccttcctgcgcgcgccactcaacatcattgacatcctggcgctcctgccgttctacgtgtcgctgctgctggggctggcggcaggcccgggcgggaccaagctcctggagcgcgcggggctggtgctgcggctgctgcgtgcgctgcgcgtgctctacgtgatgcgcctggcgcgccactcgctggggctgcgttcgctgggcctgaccatgcgccgctgcgcgcgcgagttcgggctgctgctgctgttcctctgcgtggccatggcgctcttcgcgccactggtgcacctggccgagcgcgagctgggcgcgcgccgcgacttctccagcgtgcccgccagctattggtgggccgtcatctccatgaccaccgtgggctacggcgacatggtcccgcgcagcctgcccgggcaggtggtggcgctcagcagcatcctcagcggcatcctgctcatggccttcccggtcacctccatcttccacaccttttcgcgctcctactccgagctcaaggagcagcagcagcgcgcggccagccccgagccggccctgcaggaggacagcacgcactcggccacagccaccgaggacagctcgcagggccccgacagcgcgggcctggccgacgactccgcggatgcgctgtgggtgcgggcagggcgctga

SEQ ID NO: 108729 - DNA, 1797 bp, Homo sapiens
ccgccctgccccgcccagccggccacctcttaaccgcgatcctccagtgcacttggtagttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccagagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgacaaaaaaaaaa

SEQ ID NO: 108730 - DNA, 2249 bp, Homo sapiens
gccgcccgcccggcccccagcccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcagagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgacaaaaaaaaaa

SEQ ID NO: 108731 - DNA, 1820 bp, Homo sapiens
gccgcccgcccggcccccagcccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcagagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaatacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgacaaaaaaaaaa

SEQ ID NO: 108732 - DNA, 2214 bp, Homo sapiens
gccgcccgcccggcccccagcccggagagctgccaccgaccccctcaacgtcccaagccccagctctgtcgcccgcgttccttcctcttcctgggccacaatcttggctttcccgggccggcttcacgcagttgcgcaggagcccgcgggggaagacctctcgtggggacctcgagcacgacgtgcgaccctaaatccccacatctcctctgccgcctcgcaggccacatgcaccgggagccgggcggggcaggcgcggcccgcaaggacccccgcgatggagacgcaacactgccgcgactgcacttggggcagccccgccgcgtcccagccgcctcccggcaggaagcgtaggtgtgtgagccgacccggagcgagccgcgccctcgggccagcgtgggcagggcgccgcagcctgcgcagccccgaggaccccgcgtcgctctcccgagccagggttctcaggagcgggccgcgcaggagacgttagagggggttgttagcggctgttgggagaacgggtcacggaaacagtcccttccaaagccggggccatcgtggggtgggcgagtccgccctcccaggccgggggcgcggaccagaggggacgtgtgcagacggccgcggtcagccccacctcgcccgggcggagacgcacagctggagctggagggccgtcgcccgttgggccctcaggggcctgaacgcccaggggtcgcggcgagtccacccggagcgagtcagagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactatattacaaactactaaagtctaagggtcgagc

SEQ ID NO: 108733 - DNA, 414 bp, Homo sapiens
tagatttataatttgtcagcttttaatacttgtagtcagccagcttccttccttccattctgttaaaactactggaaagttttctgtgacctgagattttatcaaaccaaagtccttggcttgtgctgaccttgctttgggtcttgtttcaggtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgacaaaa

SEQ ID NO: 108734 - DNA, 247 bp, Homo sapiens
acaggcgtgagccactgcgcccggcctggatatgctttttagttcaggtgtggctgaccctctcaatctgtcatttaggtagttcagtaaaatactgttctagggaatgtggtagagtcagggagggaggacagcaagatgaaaccaggaacacctgtttgaaaacagctgctttcccgcaagctcccaccaggctgttctaagacgagatggaaaggcacttaccattctgtcacatcccaagcaa

SEQ ID NO: 108735 - DNA, 786 bp, Homo sapiens
agatgctctttgttctgtgtactatttttcccctctcctaacacaagcatcattaaaaaagtcttggagcattgatacatcaaaagattcttctttctacctactttatcaaaatcactatgaacactttggtgtatgttcttctagactcttttctttgttaaaaaaacaaacaaacaaacaaacaaaaagcctagttttgcacagagtatcacagcgtgcacttccttgttaacctgttatttccccctacaaacaatgtgttgtgaacaccttcctatgttagcagattgatttctacagcatttaaaattggctgtagagttttgcattgtatggataaaataccttccaagttttcactgtttcatactgtgatgtatgttttcatacattgttctaaaatatcttaagccacatcgtacatattgccagtttggttctctgtgaattttactggtaacaatacaacctagatgctcagggttaattaagtattctggggcaaagtgccattgaacctggttcctggtacatacattcattctgattattggttgggataggtttatagttgtgaaataggtgctacagacagttaacataaaacatcctgtagctctcagaagatagaaaatgcaccctttaactttcagaaacttgcatacctataaacgtagaaacaaggaattgcatttttattaattcatggaatccagtcttcataatggatttaaataattctatttaaaatatgtgcacacaatctaaaagcattttgtcatt

SEQ ID NO: 108736 - DNA, 1854 bp, Homo sapiens
gagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaaaaaaatattcttaacacataaaactagaattagtgggaagaaatgcctactgtaaactcaacagaaccggggttaaaaaatataggataagttttgactacctaaaagtagcagggcagacccatctcttccctaactctgtccataattcagaaagggcccagggaactgtcctcaggaatgctcttcccccctcttccttgtcctctccgacagagcctttctaatcagtaggaggtcacaacttagaaaataaccagagagagctggaatggtaagttaggggctattactgttatattctgagaatcctgatccatgaaaataaagtgctgaaggtggggtagagttagaaagacctgtgttcactgagggttttgagtattacaggctctccatcactcagagcatcagaaagtcaggcggtgaacgcaggagatttttctctcaggctaaccaaaaccatgttgaaatgaaaaccactttggaattggccttttcgtctcagactgccaaataactagcacccaagtggatcccttagctcagagcagtcaccaggcatgggtaggtctttccttgtttagtgataaacaggaaaaacctaaccgagcctactgaaccatgtccatctataaaagaaaaagggagatcatactggagatttgaaagaagagtagacctccagaactgattgattataatttatttctgttatagtatttccacttagtattatgatttatttctgtccctcatgaaagggacagaaagtagtcaggcggttatgagatgaaaagacagtaagatgggatgaaatcggagtgaaacaataaaaaaaagactaagttaaaaatgtaatagcatattaaaattcatgtgtaagggggtaatgagctgaaaataaagtctgtgttttgaaggagaaacaagataaagctctttggaatccaaaggataaaaacataaaatgagggagaagatatatagagagaatatctaacaggagaattacaagtgttgataaacagggaaccaagtgaaatagaacaacatcattataagaagttttcatgcacgtgtgcagatttgaaagtgttgccgtatttttcatgtgaaatcaatgaaaaatatgtttgggcatttctatttaagaataatgttaaagtaccttgccaaaatatctggcaagatattagctaccagggaacaaagttgtttttcttctcctttctagcaataaatgcc

SEQ ID NO: 108737 - DNA, 246 bp, Homo sapiens
  misc_feature (215)..(215): n is a, c, g, or t
  misc_feature (220)..(220): n is a, c, g, or t
  misc_feature (223)..(223): n is a, c, g, or t
  misc_feature (242)..(242): n is a, c, g, or t
tggtggtctccaagtaaccagcttcctgagggctcagcaggcggaatcctgcccatcacgcttatgtactggcaggagtgtctggctgtgattggaggtgtgtgtgctctgtacagaatcgactggtgttgcttagatgtccagagtgggaggggagaggggaaaaaacaaaaccttaaaattctggaaaggaaggaagaaaggaaaaaccctcngactngtnggtaaatgggaacttaaangtaa

SEQ ID NO: 108738 - DNA, 3051 bp, Homo sapiens
  misc_feature (920)..(920): n is a, c, g, or t
  misc_feature (1248)..(1248): n is a, c, g, or t
  misc_feature (2457)..(2457): n is a, c, g, or t
  misc_feature (2930)..(2930): n is a, c, g, or t
  misc_feature (2939)..(2939): n is a, c, g, or t
gttgcagaacgagcaagcattattaaagttagccctctacactgaaccatgttcgagggcccctttcactccttctcttctaccccgcctcaccgaccctttcccacctgttctcatttctgcgtctatgtccgaggaggctcaggtgcaaccctttccattggaaccaacccactcccatgcccagtggttctgcatgactttattgacataaccacactagtaaataaaggagagaagaagccagtccttggatgaagtttcctcttgcttttccagcgaatgatacgatgggtctctgttcagccctgtagcctggggtgcttttggcagaggtgccttttccttcgacagtcctggaaagcaggctgcataaaccagctgcctagaactgggaggtgagtgcggaggaagaataggtagagaaaacttaactggctcatgttcttcgaagctgccacatttcccgaatatgcccacttgggtcagatttcgaaggcgaagccttttgcagtcatgaactgcgggagcccaggctgtgttcaaattcctccggaagaaagaaagaataaacgagaacaggctgtggaaaagaatgtagttagtgtcttaaagatggccaaatattcattctcatttgtccttttatatgaaacagatttttaaaaaggcaattggagtagctaatgacatccagaaccccgttgattcgagtggggctgggggtgggggcttaaattggcccaaacagctaatcaggccgaaagaaagaggtgagttgattaccctggaaattgcacaggaattcttcaaagatgtggccaataattagagtttaagatgctactctttatgcacataacttagcataattttattaggcagctcatcaccaacagaattagtgaaaatcaggccanaaaaaatctgagagccaggcttatgcagacgtggaggcttttgctctaaaatggtctgctcacgcttggggaagaccccaagagaaagcactacctttcttctgggccctgagcgggttgggagtggaaatgaatcagagccatttcagggggctgtgctggagttggggacaatgtggcctggacctagctgggacggacacagacttggtttgaacaccagtttccccacttactggtgagtgagatggggccaattccttaaattctgacctcccattccttgcctgtttttgggagcaggaaccccatttgtgaggatcagccntgaggctgatggcattggaagcagtgcagatatagaaacagtagctgtcattatcactcgaggctgctgctgatggagggaggcctggtctccaccaagctcaaaagcccttcatcagaatgggtttatgctactgtttcccccaaacactgcagtcacctggctggctagagttcttagaagatttcaaagtttgggggcagaggcaatgtccaaccttgaatctttttttttttttttttttttgagacagagtctcactctgtagtccagatgcccaggctggtgtgcagtagcgagatcttggctcactgcaacctctgcctcccggggttaagagattcttgtgcctcagcctcccaaataggtggaactacaggtgtgtgccagcatatctggctaatttttgtatacttagtagagatgaggtttcaccatgttggccaggctggtctcgattgcctgacctcaggtgatccacctgcctcggcctcccaaagtgctgggattacaggtgtgagccactgcacctggcctcgaccttgaatctctctgtgcacctttcatggatttgcaaacttgcccagggtcctgtggccccagccgtggttctcagttggaggtgaacctgcctccagtatgctgggctggcctgggcatccctgactggagaatgtacctgtcatggggcaggggacatacagacaaaggagaaggcaaagggactcctcaagaatccatttcctcagggatctggaagggagaatgaaagtcatagaattggccaatcattaaaaacttctctttttacattaaaacaaacttattaatataatagaaagcagaatttacttgtgttaaaaaaatatagctaaggtatgcggggcttaatacctaggtgattggttgataggtgcagcaaaccaccatggcacacgtttacttatgaaacaaacttgcacgtcctgcacatgtatcccagaacttaaaattcaattaaaaaaaaaaaaacacacaaggcatgagataattgagggggaggaggtggctggtgcccatgtggatgggcggcggcggggcttcactattggcttctgctcataggatccagaggtgcagcttgagaggaactggcttatccttagcaagccaggcgtctggcccatggttagggctcagtaaacctttgtgacatttgagttggttttnaaaataattctggtaaaatatacatagcatacaatttattattttaaactttattttttttttgtgatgagatctcgctctgttgcccaggctggagtaaagtggcacaatcatagctcactgtaaccttgaactcctgggcttaagtgatcttcctgcctcaggaccctgagtaactgggactacaggcccaagccactgtgcctggctaattttttaatttttttttttttgtagagatggggtcttgctatgttgcctaggctggtcttgaactcctgacctcaagtgatgctctcaccctggcctcctaaagtgctaggattacaggccatttcaactattttttgtttgtttgtttgttttggtttttgagacggagtctggctgtgtcgcccaggctggagtgcagtggtgcgatcccggctcactgcaacctctgcctcctgggttcaagcgattctcctgcctcngactcccanctactcgggaggcggaggcaggggaattgcttgaacccgggaggtggacgttgcagtgagtcaagattatgccactgcactccagcctggcgacagagcgagactctgtctc

SEQ ID NO: 108739 - DNA, 438 bp, Homo sapiens
aatggtccttctgtaagaaagctgattctggcaccaacagagaggctgcctcagatgaagagtgttagcacccgaagggacccccaggcctgtcctgaccctcccacccctgctgtcggcccaacttgtgtccctttcctggaagaactgcttccggcggccagtgtgctatgcttcctcctggctctgccctgcacccccagaacagcccctgggcttacgggagacactagtctctgggcttctgcagccaatcaagctgctgggccctccctcccaagcactggaggaggtactcgttctgtgggccggggcccctccctcctgagcactggaggaggcacttgttctgtgggccacggcccctccctccccagcactggaggaggcactggttgtgtgggccctggctcctccatgtctgagggaactgctctg

SEQ ID NO: 108740 - DNA, 473 bp, Homo sapiens
gggctgaccatagaggttccgaacgcgtcaaatcgaagatgggtgctacagactagtagacactttgtggcataaataatacagtggtagaacaatagagtactttgtttcttcttgactgaaatttcttactgaattccctggctgatatttttcattgtgagttgcttatctcgatgtcctgctttgaaaagtatgtgtttagggaatgtttttatttgcatacttactatgtttgctatggaaaatttagaaagtaatgttaagtaaaatgaagaaaataaaaaccatctgtactccctccattctagcattaactactatttagattttggggataaagttttcctgtctttttacattaatacaataatagttaacatttattaagcattttctagtaccaagtactattccagttgctttacatgtattcgtctaatcttcgattttgacgcgttcgggtaccgaga

SEQ ID NO: 108741 - DNA, 857 bp, Homo sapiens
gggctgaccatagaggttccgaacgcgtcaaatcgaagatgggtgctacagactagtagacactttgtggcataaataatacagtggtagaacaatagagtactttgtttcttcttgactgaaatttcttactgaattccctggctgatatttttcattgtgagttgcttatctcgatgtcctgctttgaaaagtatgtgtttagggaatgtttttatttgcatacttactatgtttgctatggaaaatttagaaagtaatgttaagtaaaatgaagaaaataaaaaccatctgtactccctccattctagcattaactactatttagattttggggataaagttttcctgtctttttacattaatacaataatagttaacatttattaagcattttctagtaccaagtactattccagttgctttacatgtattcgtctaatcttcacaataacttcaagggggcaggtattattgtcctcattttacagataaagaaaatgaggcaccaaatacatgattggtggggtatattttagttttttgaaaatgctatttatatagttttataccttgttttttcatattattatccttctgtgtatacctaatattctattatgtgcatagttcctcatatacttggtcatatcgtaagttttggattttaagttctttgcattgttaattataaggtttttatgaatatttatttagcagaatttctacccacctcctcctgatcttcttccttctaataatttggcaaccaaaaattgatagttttaatttgcatttcattgattacccctgatatagaattttttcatatacttatgccatttttttttctattt

SEQ ID NO: 108742 - DNA, 1270 bp, Homo sapiens
atagtgagtgagttctcacgagatctgatggttttataaggggcttcaccgctttgctgtctcttctcgctcctgccgcatgtggagaaggtgcttgcttccactttgccttccgccatgattgtaattttcctgaggcctcaccagctgtgtggagctgtcagtcaattaaacctctttcctttgtaagttacccagtcttgggtatttctttatagcagtgtgaaaatggactaatacagtgctcttttaagtaccgtaactgaagaggagatgagatagttttttggagtgaataaaacgttctgtacttcataaaacccaagctgtcatttaagtcagcacctggggagtagtaataaatgactcttcttaggggctttctgtgggagcagtgtgaggaggcctcagccttccttatgtaggtccattagtttagagccacattcttttctcatggtgtcactgaagtttttgaggtccagaagctccctttgcactctcttcatcttgtgagctttcagtctgtctctagatttagggcaagaaacctgtggtggtgagggcaggtggcaatgttcacctgatagacagctaggatttcttgttaatctggttgtggttatcatttatgtgttaactagctctcatgagtgtttgcccccaaggcctgcagaagacaggtaatgtctcttctcacttacctgtgtggggcactccctcagactcacagaggatgaaggggtgtgtgttataaaatgttctgtttctgcttcctacttcaagcaaagcttgcttttcatcactgacctctgtgttatgtagtcatagttctttgtagtcactgatgaacatcttcaatgtgctccaaacattctgaactcctttctaattcctgaagatcccctactaatccctaggttgagaagtcagaggttctaattgatttgctgtttgctgccttaaggtttgtgttccctagaaatgatgtttcattttgtatgtacttccccccttactgaactgcacccaaaacaaatgttgtaggttttgacatgggaaagctttagctgttcaaacatgcacaccttgctgacattcaaatccacagactgtaccacacatcagtgtttacagagttcttgacaggtctgaaaaaacattaccatatttatcatttccattggtagaacagaataatggcaaatgatatacatgtagtcctccataattaataaaatactttcacatctgtaattattattcacaa

SEQ ID NO: 108743 - DNA, 321 bp, Homo sapiens
agctgtaacttaaaatatctaactttaaaaacagacatttagtgtataggactaaattattaatatatggttgccagtatcatatttgcaagcattatctttaagaggccttgagttactctttgagacacccttgtcacaatgcgacctagtatcacaaatgctgactgatttagagaacagatgcactgggaaaataaacctgcaagaagtgttatctttcctagtaagtaactgtgtgaccttggcaaaccacttactctctctgggtcctagtaaaatggagagtttggaaccaatggccttttagattctttagag

SEQ ID NO: 108744 - DNA, 339 bp, Homo sapiens
gatcctctacttctcaccctcttatgttgggaatgctttaggactcattcctaaggcattccctcaagtttggatacttaagtttcagttcctgaatttctatttggttattttacaaatctgcagtgtcatttctgttacagtctccaactctgttaaaattttttcaagcttggcttgtattccctagaccacagtaagtaggttttagtctatttccattgtttctgctggttctcattcacggtatcttaccttctcatatgcctggtggggtacatttgattctgtgccagaccctgcatttaaaaagtctagaatagtaacttgaggctcaga

SEQ ID NO: 108745 - DNA, 1152 bp, Homo sapiens
catgtgtaaattaatatcttaagtattttttggtaaagagttaagcaaagattgaattatttttagatatttttaaaattacagaaacactacatttaagttagaaaattaggaaaacagtcatcatatggagagaacaaagaaataaaaatactgaagtctgaaagagttttagatgttttatgtgtaaatgaaattggtaccatacagtttttctaattttctaattaaatgtagtattgtgaatattttctcttgggaatgattacttttctttggagtttgatagtggtataaactgtttatattttgtattctatcaggaaagtattacagtaatggaataattataatttcattgagtgcgtctcctctttttaatatgaattttgagcaagtttttagattcatttatatgaagtgtccatttttgtaggtaaaagtagttgaaaaaggtaatgtatggttcaacctaataacagaaaatatctagccttaattagaaaaataagtcataaagacaactttgtttcaaataaggggaaatacgatagcagtcatgaaaaactgaaggatacaaagagaatattttaattggtagccatacaaagtggagatattttagaatctatttcattctctaatatatttgagtcattttattttgggtaaaataaattataggcggagcatggtggctcacgctggttatcccaacactttgggaggctgagggggcccaaatgcttgaggccaggaatttgagaccagcctgaccaatatggtgaaaccctgtgtttacaaaaaataaaaaaaaaaaattagccaggtgtggtgacgtgcacctgtaattccaactactcgggtgactggggctggaggatcacttaaacccaggaggccaaggttgcagtgagcagagataatgccactgcactccatcctgggcaacaaagtgacacctgtctcaaaaaataaaataaataaatagtagcagaatccttttagcaggctttaatgttaagcatgagattaccattatttgtaacattttttaaatagggacattttactgtttcttacattgctgcttatttatgttatttggcatttcctggctggtcacggtggctcacgcctgtaatccctgca

SEQ ID NO: 108746 - DNA, 407 bp, Homo sapiens
agccatcaatccagcttttgcttaagctactaactaaaaaaactcactaatttatacagtttgttttagatgcaacttatagagacaaataaacccttcaaggtgtagcccaaatgctaaaatatcagggtttccctgaccctcccacataaatacaagttttcccttctgaaaactgccacagcacttgatctgaacgtatcttctgggacctctgggttcttgccatagagtacaagtctgcacacacatgcaacttatccataggctgaaactctccacaaattcaagcttcgaaggcaggcattctttttcatctggcaatagctatcataacaccagtcatgaaataaatgctcaataagtgattgctcaatggctgtctggctggctggcggtggttctat

SEQ ID NO: 108747 - DNA, 791 bp, Homo sapiens
gtgtaaatcaaatgtgtaaatcaaacatgtaccagtcaaaactgagcttcaggcagtatagaaatattccattctacaaacttttttttgttgttgtggtttttatctcaggttgagacttaagggaacattttcaaaatagtgtaagatctggtttcacaattctgtgacagaggacatgattttattgttgaagttaaattttaagttattgtagctttttttaaagtaaattaccctaatgcagtcatatgagctgatgatgctatgatttgtgtcactgctctgtatttttcagtaccaaataattcctttgttaaactcattttcagtaaatgagccattgtttccccaagggtaatgattatttcccctatatatagtacaaagccttgagaaatagatttttaaatctaaaatatgagttaatgattggaaaaggctgaaatcatcactgtgtcaactgtatgtgtgaaaagggcaactgctgtgtttgctgcctaggctacaatataagatactatgtttacaagaaatccaatgacagcaaggctttaaaagtgaggtctttcagtttagatgcaaaaagggtggttctgttgagtcaacccagctatttcactacatagtttcgtaatgtaaacacctagaatgaggtagctggagtgcaaatctaaatggcttgtgacagttaaggaagtacataggcaacagttactggttttcttgatgcagctgatatcagtatcttcaaataaatcactgacttaaagtacctcagcaggaaagac

SEQ ID NO: 108748 - DNA, 100 bp, Homo sapiens
cgaggttttgccatgttgcccaggcttgaaggagcattttgtagactgtaaatagttaaaatggtgtctctcctgtggttctctgattataattttttaa

SEQ ID NO: 108749 - DNA, 451 bp, Homo sapiens
aaatgtaatggataccactcctgtgattaggttactcatcaaaagagattgtcctggatgggcctgacctaatcaggtgactcctttcaagaagccaaggtgtctgagagatgttcttctgatggactggaggaaagcaaacagccatgttgaaagagggcggtgggggcatttggcaaggagctgagtatgccctttaggggcagagagtgatcctgggtgacagccagcaagaaaatggggacttctttttcacaatggcaagtaagtgaattctgccaacttgaatgagcttgcaagaggactctgcttctcaggtgagatcacagctccagatgataccttgatttcagcctgctgagacacccgagcagaggaccccactaacctatgctggactcctggcccatggaaattaagagataataaatttgtgttgttctaagccttt

SEQ ID NO: 108750 - DNA, 547 bp, Homo sapiens
  misc_feature (15)..(15): n is a, c, g, or t
tagaggatcccgatnagagcatacccctgatatactaaaataaagtaaaattcatagcacagattatcacaggtagagataagttagagcagataaaggtggagtgacaggtttggttgcagtccctgtctccaagtgactactaatgactatgactaccacacacacacatgcgcacatgtgcttctgcacaggcacacacaagatatatacacaatctgtgaaatagtaagtgagactgtcagctaagaggatgggcactgtgaggccaggagtaatattcaaaaatctttcagctgtgttggcacccttcatggttacattttcataggcagccaaacaggggtgactggggggaattcaaagagctggtatgaagccggcttcaggcagccaaatgggtgctgggcatatgcctgctgtggccccaacaccataaacactgttgctttccccacattccatgcctgctattgccactataatgcgcagggaccaggccagccaaacagaggtgcagtgggccagctggagggctggaagctga

SEQ ID NO: 108751 - DNA, 1174 bp, Homo sapiens
ggtaagctgttgtttgcttgccaaggaactggagagtgcaggtttcaagacaccttgaggaaattctcctgagcccttagccaagagaagagagcagaaaatgcttttctgtagaatcccaagaggcataaaagaggatgagtaactgggtcctgtgccaagttcccaacccctaagccttcccaacatggagaaactacaccagtgtttaaaagtttctaggttggaggaacaaacttgagcatcaagggcagatgatttgttaacacagtcctgtgcagagggctccttcagaaggcatcccctgtgacccaaacacagtgagcaccttctactttctggccttatgccatcaatgcatccagctgcaatctatcctcaaacctggaatccatctcttgacttcccagccagaccaccttccatcccttcactgtgtcccaccctgcccagaatgcatgctgttctcccagagtctcatggaaataaggccttgcactgaaataggctgtgggaaacaaaaggataagcaggtctggaccagtctgtaatggtagcaggtgaaaacaacttatggaaaaacacatgaattcattaggaaataaggtgacagatccccagctgctgaagaactagaatgtctattacactcatacaattgatgttttattttaatacaccagagctaccacacataacttccttccatgtgaaaggctccagataaaattctgccatccctcctctcctcatgtcctcctgctcagacccaccttcgatgcccctaaaccaatctgcatcatgcctgtttcagagagtcatgggaagatgggcagtgcctccattgtcaccattccccacacctctgcacacttctgccccttcccctctagacgccacaacttcacagtcttactgttgtaaatattcctgcacagttagtaatgatcaaatgatcctgtggtcagaggcctctttggcagtgtcttcttacccttaagaaaggtcatgaaatccagaaggggcaacctttccaggagagctttggagtcatttctgtgtgagacactattgcataatcctgtaagattgcttttatatttaaggaatgatgttacttaacaaatgaacaaaaaaaattgcaaataaattttttaacaatgtttacattggc

SEQ ID NO: 108752 - DNA, 1117 bp, Homo sapiens
ggtaagctgttgtttgcttgccaaggaactggagagtgcaggtttcaagacaccttgaggaaattctcctgagcccttagccaagagaagagagcagaaaatgcttttctgtagaatcccaagaggcataaaagaggatgagtaactgggtcctgtgccaagttcccaacccctaagccttcccaacatggagaaactacaccagtgtttaaaagtttctaggttggaggaacaaacttgagcatcaagggcagatgatttgttaacacagtcctgtgcagagggctccttcagaaggcatcccctgtgacccaaacacagtgagcaccttctactttctggccttatgccatcaatgcatccagctgcaatctatcctcaaacctggaatccatctcttgacttcccagccagaccaccttccatcccttcactgtgtcccaccctgcccagaatgcatgctgttctcccagagtctcatggaaataaggccttgcactgaaataggctgtgggaaacaaaaggataagcaggtctggaccagtctgtaatggtagcaggtgaaaacaacttatggaaaaacacatgaattcattaggaaataaggtgacagatccccagctgctgaagaactagaatgtctattacactcatacaattgatgttttattttaatacaccagagctaccacacataacttccttccatgtgaaagcttcgatgcccctaaaccaatctgcatcatgcctgtttcagagagtcatgggaagatgggcagtgcctccattgtcaccattccccacacctctgcacacttctgccccttcccctctagacgccacaacttcacagtcttactgttgtaaatattcctgcacagttagtaatgatcaaatgatcctgtggtcagaggcctctttggcagtgtcttcttacccttaagaaaggtcatgaaatccagaaggggcaacctttccaggagagctttggagtcatttctgtgtgagacactattgcataatcctgtaagattgcttttatatttaaggaatgatgttacttaacaaatgaacaaaaaaaattgcaaataaattttttaacaatgtttacattggc

SEQ ID NO: 108753 - DNA, 315 bp, Homo sapiens
cccagaaaggtgaagcaatggttgatggtcacacagctagtggcagcagagccaggactcaaacccagagagtctggctccagagtccatgatctcagtgccaaagtctactgcctcctatgagcacaggcagccaggactagaacctgcagggggatgccctggcccttccttgcagggggtcctctccatcgcctgcaagggtggagaggcgggggctgcccccactcagcaggtgtgaggggcaggaatatcactcggctcagaggaatgtgtgtgcttgtgagaaagcgagtgtgagtgtgtatgagtgtg

SEQ ID NO: 108754 - DNA, 475 bp, Homo sapiens
aagatctcatgactcactccagtgtggctgggcctccagtcctcactctgaaccaaagtcctggaaacacttttccaccacgttgagagaaggcgagggaagaacagggtcaggagtgatcaaatgcccttagaaacagtctctttctttccttttgggaaaacaaactcactgtgtaataaaaaggtacaaagccaactttggaataataatcaccccgccccatccccttgccctctgatggaaagtgccttgtcttctccatcaaggtctagctgggggcttgaacggcctccgtgtcacctctaattccccagtttttaccttgtttcctttctctgtatcttttttgcccttagttgtgtacagtcttgtattttttcacataggctatgctttctgtggatgttgcctccctcgaaagcagggaccatgtgttgaacccctgttgccttttcccagagtagcgggcacc

SEQ ID NO: 108755 - DNA, 421 bp, Homo sapiens
aaccccagactcacacaccgtagaaggcccagtgtctgtggagctaaaactgcactcccttccctgcactacgtcctctgttctgtctctatcactctggtagacttgcccaggcccaccacctctgcctaggctctcaaagctgccacccaagtggcttcctgcaattcttcccctactctagccagcttaagtcggttacctccatcacctgccctaaaacaaacacctgagtcaccccctcacggtctccacagctctgcactgtcattgacctggccaaggggagccactgtctctccctagagcacgtctgtccacaccctcctcttgcctggtgtgccagtgcccttccctacactcccaccctgaattctgaccactcttcagggtccactccattaaccccaacccaactcct

SEQ ID NO: 108756 - DNA, 413 bp, Homo sapiens
gacatagtggtctttagtagcacatgagaaagactatccccagtgatgtgcttatgatgttgtgttctcattgtagcctagggcttttcctcgcctcctctgtttccttttccctagagccctgtgtcagcggcaatgaatgcttaagtaggctctgtcaggaaaactctccgtgaccttggaaacggtatttaacctttctgtggatcagcatccaaatagcaaagcaataatgacaggagctgcctccttcacaagcctatgagttgtgactaagaaaagggattgtaaaacgctctgaacatcttaaatactacggacaaatctaacaatgttaatcactcaccagctcatgcccagtggtcatcaccagacccttaaaatcagttgctttctaggagtcttaggtcact

SEQ ID NO: 108757 - DNA, 522 bp, Homo sapiens
gcgtcgacaaatacaaacaaatattgataacataaattgtactgcaaagcagtattcctcagcctttggttgggtctttgatatgtggtgatatcctgggtttcaactcttctacaaggttttcttatatataatgtaggatagatacagttgttctgtgatttgggatggttataaaattaaataaccaaatggaaaggcagaaagtgagaaatgttaagtgacattgtagtaccatataatattttagatcttgacttaggcatatacaaagagtatcttacttattttatacaaagtctacaatgttatgatgctacaaagaatgagttaagaatgagtaaacgctaggttttatggagactcataagaaaatataaagattttcgtcttactattcaagtttgaaatgcataaatgaagctttataattggtgtgcaaaaccagacatagaacctgcccttctggactctctggtcaagtgaagaaagagtaatcaagttaagaaatgtaaaaaaaaa

SEQ ID NO: 108758 - DNA, 315 bp, Homo sapiens
tgcccaggtggtttcaaactcctgaactcaagtgatcttcctgccttggccgcccaaagtgctgggattataggcatgagctcccgcacccagccatcagcttgctccttcaaccttcaagctatcgtgtcctttctgggcttgtgggagtctcacctccgcttacacagttcagggttcagccaaagatttgaggggaccttatactcagactttgggttccttttttagtgggttcctcctttcctatatttccctctcaatttccagcttctttagcagtctcaaatcctccttcaacctggtcgaccgtct

SEQ ID NO: 108759 - DNA, 289 bp, Homo sapiens
cacggaccctgcaggaggatcttaaaagggcaggtgagggatctgcaccttccccaagaagctatcagaagccccagctggggtgtcacgccccacgggccactcagcagttcctcactacactgaaagcagccacctctgccatgggaggctggagtagaggaagcctgcgagagtcagcctcacagaccctgggcggggctggagaggcagctgggaagagcatgggacaggaggtgggggtccctgccattatatcagagccctccccagctcccaacaaacacca

SEQ ID NO: 108760 - DNA, 610 bp, Homo sapiens
tgcatttcaaaatcattttgtcctactttattgcaatgagtgcaaacacacacagtcataaaatacacaaagatagttgttacctttctttggtcagattctttgagaatgttatgaatgctagagatccttgtcccctcaaaatgagcacacacacacacaaacaaactggtccatacacatacacacaccaacatacttgtaggtttgctttttaggcaacagagcattccctaactcgttccaaagtctatgattcaagttaagaattactgaaataaagaataagtatttggatttacatgggaatagatatggaatacacaccatacacacacacacacacacacacacacacataatatatccaaatatttaatgactatttaaataagtcttatacagtacacaatttcctactcaatctgatatatgcaattgccactgacaaaattctaggaaaaggatcaacttatgctctgcataatgaagtgacagatgctcctacagtgttctgcaaaccactatttacttgaagcagtttcacaacttctatgtgtttacagcagggttgaatttgatatgacaacttggctcaatgagtattaca

SEQ ID NO: 108761 - DNA, 537 bp, Homo sapiens
cctcactagcctctgcccaggatatctctccactcctccctggccatggtggcggatccggtgggaggggcctcatctcccaggctgtcaggcttcgctctgcctgcgaccccgactctaattctgcctggggacggctgtgggggtgtcctgcagctggtgctcgccggaacccagtcctcccccagcagcatgggacggttggcccggagccttgcaccgaacgttttgccccagacgaggcgtcctgtcagccgaggcgtaatcctgctgcccactctctcccagaaggagaggcagtcaacccgaggtgctgtgctgcaggacagtctccagcgcgtgctcgtttaccgccttaatgattcacctaggttgctttgtccatgggggtcttggggagaccaaaacttggtcctgagtgagtttcatttatcgcacattgaactatgagctctcaatcaagtgcaagttatgggagatcagatttatttcacctattgcaaagcaataaaaatgaattttatttgaaaaaaaaaa

SEQ ID NO: 108762 - DNA, 339 bp, Homo sapiens
aggaatgtgggtccgacgagttaagttctggcccagtctcagcctccgtggactggcctggcctggtctgatttccgcctccgtggttaggtctggttttagctttgatgaccgtgccctgccccaccctgcctggtggcctggggaggctcctagtgcagatatgtggagggtttgaactccaaacagtctctgctgactgtaaacacctgtggggtgggggcttggagctctctgttctcttgcgggcctccttctgcctgggcctgtctgccattcgtgagtgagccctggccttcccgtcgtgtgcaagtaaggggtcatttgtggtggaagaag

SEQ ID NO: 108763 - DNA, 616 bp, Homo sapiens
cttgtttgttatcagctctgtgagaacaggggccacgtctgtgttgttcatctctgtatattcagattctaatacaatacctcacacataggaagcattcgctgagcatgtatttgctcaacaaatggtgccatatacttttatcgccatgaaaaagaacgtgatagatctatgtgtttgtatacaacagtcttatgggaaaaaaaggcaaagttagaaattgtgtatagtatgtgtgtgtatgtagtgtaattaataccatatgtaaaagtgttttcacgaaagataccaaaattaatactgattgtctctggggacagagaggaggagtggaagggagattcttcattgagaatcattgacattctgtggtgtttgaattttttaactttgtacatgtattattcttttaaaaggattatgtattctttcttttaaaagggtttaaaaaattaatgcttaaaatgtcaactggaaaagaaaggtatgacttctgccaatcatttttaaaaatatatgtagtatttatgtagaactgctcatgcaattaatcgttaaacaaaatcaataaatttcaggccttttttttttttttaagaaacaggtattttccaag

SEQ ID NO: 108764 - DNA, 661 bp, Homo sapiens
gtgtgatctctcccagtctcctcatttggccaatatttaaaactctagaaagttgacataaaaatctggattactggcttttcttgagaaatgaaaatttctgccactaccttccctcttcatctatggtaacactggggtggcacagagtagatggggtttgcccttttgtggtccctactcagtggctttactcatttatattacctgcatggttcctgtaggcaactgcttttcccactctagggtaacatgtttccctttgatgaccatgttaatttcattttggaaacaatttgttctctagattaaataccaaacatactatcttctcagactacaggttaaatattctttacccttttataaagaataaataatgtctatttattggctgcttcaccacatttaaggcacaatgctaaatgttttacatgtattatttcacttaacccacataaacattccaagagtaggcactaactttgtgcccatttcacagatcaggacactgaggttcagagaggcgtccttaacttgttgaagttacatagttgatgattggtcgaactcggattccagcccaaatctatttgagaccaaagcctgggctctcagccactttgccattgccactgctcgctcttattctcctgataga

SEQ ID NO: 108765 - DNA, 398 bp, Homo sapiens
gcatggaaattgatgttttggggattggtagatgattgttggctggtccacatttaacttctttctgttaaacttgtagatagtcaaagtgaagttcattaaatattttctgaaatcagtttattaaggtgacataaagtattttaaacatttaaagaagtattaattaaaatggtattacaaatttagaacttggtatatttagaactttggttatattgtctgttcttgggttttcatgtgaatataagacaattgctattttttttcaattaagaggctattttttaaaacagttttagacttacagaatgatatgtttaaaatactttatgtcaccttaataaactgatttcagaaaatatttaatgaacttcactttgactatctacaagttt

SEQ ID NO: 108766 - DNA, 286 bp, Homo sapiens
cttccacactccatctatctttgtccaaaccactaacagagactttcttacccacctcctgaacaaaaccaagttccttttaatctccacatctagcataaatatgcccccaaattattactttgaatatcatttcctgctttgtgcagcatcaattatccatagcaaagaaagggttctaaagcatgcaactggtttaaaatgagttgcttcaccattgcactgatcagcagacagtataacacacacaataatttgctaaggaaagcccatttaagcatttaac

SEQ ID NO: 108767 - DNA, 377 bp, Homo sapiens
ctctgaggcacggcaagaacggtgcttccccactaaagcatcaattgtattattcttttgatatgtgtattttggctatcagtaacacctgaacacggtattaaatcagatactgagttagaactctctacgtgattgcctggcttcctgcagattaggctgagtgcatcacgggcatcgacgcacatctgtggacactgataaggccatggtctctgtgactagggtttgcgaggcactatggtcaacttctgctcctggccagggggaacgcagccaatcacactcatgtgtgaggcattcagagcacacaagtcacccaaccagtcatggccgtgactgaggccatgccattctggtttcccaaatggcaaaca

SEQ ID NO: 108768 - DNA, 299 bp, Homo sapiens
tgaacattcagatgaaaactctggcaaacttcaggagctccatccccaaaggtattgatggctatgtgcaaattaacagctatactagtgcaaattaaaagcacactagtttaacacagggcctctacatcttttttaaaaagtcactttgggaggctgaagtgggaggactgcatgagcctaggagttcaagatcagtctgggcaacataatgagtccctgactccaaaataatttaaacatttcctgggcatggtggtgtctgcctgtagtcctagctactcaggagactgagcatg

SEQ ID NO: 108769 - DNA, 304 bp, Homo sapiens
tacacagccctgtatgcagagttaaggagcaaacaagatggcaaggcatccaattctagaaatgataagacagaaccatccctagggatgatgagacaaggagcaggagtttccttaagagcccagtgtaagcagaggcacaggagggcaggatggagggacgtacagcctgaaaggacactgccatggtccaggcaaagggtcaaagcaggaacagatgaagatgtatctcctttaaaaacaaacaaacaaaaaaagacagtttccctctgtcacccaagctggagtgcaatggtacaatctt

SEQ ID NO: 108770 - DNA, 691 bp, Homo sapiens
aggggaggtcagttaaaagagcttctgatgtaaataaagcaaatttgcaataagaacatgtccgccctctaatcacttgtttataaaacggctgccctctcctccacagcactatctgattcaacactttcatggtttgtcaatattgataacttatttttaaataaaaaagtgaagtatatatattttttttcaaaagccactgcttcccaagctcacatcacaagaaaaagtagcaactttttctgtttatgttcttttttgttgattcttttctccacaatatcagatttgtgtcatgagatggttcaaacattactagctctgcttgagcccctcagagaaagatatgtgtatacatacacatatatgttagtaatttgtgattgatattctttgcttatagacttgatttttttgtttaatatagtattctgtttttaggaatcatactaaactgtttcctccctgtatggctgattataagctatgactagcaaaccagattttatttgcagttgtttgaaacttcatttttcttatatgacctgattaatgcactctgaacatgaatcagtgtatcctgccctgttctttgttttgaatacatctgtcattttctgcctcacattattttccttgatttcaagtcacttgcttcttattttcaaataaaataatttttaagaat

SEQ ID NO: 108771 - DNA, 328 bp, Homo sapiens
cctcccaatctgtgctctgagcaaccccctgctctctccatccccgaccccaattccgtctcctccagaaatttgctctgacttctcctgcagggggtggagctcctctctgctaccacctgtggagtgtgatcatcaccttccggcctgccgcactagactgtgatgtctccgtgcatttgcattggtctgtgtggtgtggtaccaaggcactgatgaagaaaagggaggatctaaacttcagtccaagccctgccaggaactagcttcaagactgcacccgaggcattctgcctcactgagcttctccttgtttataaatatagac

SEQ ID NO: 108772 - DNA, 549 bp, Homo sapiens
tactgtgtcagtggtccccagcattgtagacagcagcaatgcctctggcatggagatcacttttgctaggtctttatttgtacagggtaaggtgtggtggctgctcagtcacccaggctgctgctaatcagtgcaactatgctttgaaaggagcaattcagttcatttcatcagaaaacaaaaggatcacaggtgtgtccagcagcagctagggaagaagaaaaaaaagaaatgcctaagagcactgctatcaagtctaaggcatgaaactgactttcacaggtgtgttcctggctgtgtacatacacatgtacttaactgccttccctgattccagtgagcaacatttgttagtatctccttccttatgacagcacatctctggaatactcgtatcccaagctagatctttgctacaaaaaaaaaatcagtaaatggcaatcacttcctgctgggtaaaaaatttaattcctcatccggaagttaagaacccaccaaacacggtgtggaagctagtaaaccccactatgggtgtactaactgctgttc

SEQ ID NO: 108773 - DNA, 682 bp, Homo sapiens
ttcctgtgaattctggaggctgcagcccagcgagcccgacacggtcgccagcatgtttcccaagctcatttctcgatactcagtttgtgagtcccgggaactatctaatagggcaacacaactggtgggtgcagaggccctgcaggcatcggcatagctgcagggtctgacggatgcaggcgcgtgcaattctctatgttggctacaacagaattatggttgaaaaagaggccgggcgcggtggctcacgcctgtaatcccagcactttgggaggctgcagcaggagaatggcatgaaccagggaggcggagcttgcagtgagccgagatcacgccactgcactccagcctgggcgatagagcgacactccatctcaaataaataaataaataaataaataaaagatttttgttgaccacagcagctggaatgtgaaggtggaaacgttgggatgcagcaggcatagaggggatcccaaatcctgagcatatgctgccctcgtcactagttgctcccacactacacatgaggcaggggaggtgcagactttaagccaactcacgctacaagcagggatttcagctgctatccaccacaggggaaagagtttcggctctgagctgagcaaaggtgattgcctaataaaatgaaccaaaaaaaagcaatactctttggaggaat

SEQ ID NO: 108774 - DNA, 306 bp, Homo sapiens
caataaaaaatcaattattagaaaaactaaataaatataagaaaatagcaaagtaaattaacaggtaagacatggagtgctaaaaatgattattaatattgtacatcagcatgagatttttgcaggcaagacagaaatatatgctaatacaactatttttattagatagaaaaggaccaatctagaaagaggtgttttcttaacgcactgttgggttcctaattcctgaatgattcgaaatttttgttagaaatttgaagacctagaagttgtatttacccaatctataagcaactcaaagctagg

SEQ ID NO: 108775 - DNA, 338 bp, Homo sapiens
tcagtgtggcgattcctcagggatgtagaactagaaataccatttgacccagccatcccattactgggtatgggtatacccaaaggactataaatcatgctgctataaagacacatgcacacatatgtttattgcggcccagtccttttttaagttgttctttaaattgtaaagagcaccttaccagcttcttgatatggcttctgctccaagaatctcctgttttatcagtagggataagtcatgcttttcacactatccgcactatgaagagtgccttccaaaagcatatgcttaaataatgttcagcaaataaaggagtcagtgaggctttcttg

SEQ ID NO: 108776 - DNA, 522 bp, Homo sapiens
gagacagagtctcgcatctcgctctgttgcccaggctggagtgcagtggtgcaacctccgcttcccaggctcaagcaattctcctgcctcagcctcccgagtagctgggattacaggcacacaccacggcaccgggctagtttttgtatttttagtagagacagggtttcacgatgttggccaggctggtctcgaactcctgacctcaagtgatcctctcacctcggcctcccaaagtgctgggattacaggcatgagccactgtgcccggccgattcttgctttttaagtgctgtctgctgggattcgaaagccagtggatggtgtataagagatgagttgattctcttatggcccatacaaaggtaggcacctttgaacctttcacatactgggcacctggttcttcgttattacttacaggtagatttctggtcttccttgaatagatatatcaaggccagggtcttcacatttcgggacccttgcagaattctgtggagttccatgtactcagtaaac

SEQ ID NO: 108777 - DNA, 351 bp, Homo sapiens
aagtcataattgatacttagttcttgaattctcagccttttagtgaagttctggggaagttagctcttcttttactgtgacttttaatatcttatacagatatgattaatttgcacagaattgaatttcagagcttcaagagattgttaaccagcaatttaaaaaacccttatgagattaattttttctgtatacacaattaacttaagcatagttgttctcatgaagcaaaacagagtagaaaatattattaaaatgtatgtgaagaaaaagtgttaccttgatgcaaaaacttaaatcagtgacctactctgttgtatattttcatgggctactatctgtatgcattat

SEQ ID NO: 108778 - DNA, 153 bp, Homo sapiens
agatatttgacattttaggagtagagcttaggaaaataatcagggttgaagatagttttgaccattgttcatctataaaggacagtgttgtctcataactatagctaattagttttacaaatataaaaatatttatgaaatgtttattcttgg

SEQ ID NO: 108779 - DNA, 791 bp, Homo sapiens
tgaggcgcgcgggcccagaaggtccaatgagtagggctgcatgggcagtgtaccgtaggtgaaactccaggaaactgtgaactaggtgactcgggaattcttcaaccaggttagaacctgcccgtgaggagtctggcgtcgacgattccgccagcgaactcgcagaaagagcatggttactgcatggtctatctggtaggtatctcactcaaatgaggcaagtccacacacgtggcttcatatggtcgaccttcagccaggaggtcaggatgatcagggagctgacgaactttccagttgactaggcttgactaaggataatttctgtggatcctcctgggcagaggttaggagctgctgctcacgtttctggagcatgtgcctccctcctccctaacactgatgctgtggaaagaggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacacgacccagttttatagtttttcccttcagatgattgtgatgaacttcatagtccctgtcaagtcttaagatgacc

SEQ ID NO: 108780 - DNA, 412 bp, Homo sapiens
gctggtaatgtctcattttagtagaagaggagtcgaggttcctagagctcaggtggcttgcccaaagcagtgcttgcagcttatttcagcattccaagctacagagttccccataggttctgtcagcatcacacattcatagcttcagctgcctagcagttagggctgactttctcctgatagttgtgaccagcaacgagagttcatctctactcttttaaaggttattctgttttagttactgctccagatccctggctccctccggatggaatgtttgtggtctagtaagcagtactgggctcactctcatatctttgtacttccctccctccctcaacctgcacacactaaacaattttcttacactgaaatgcaattagcagtcctggcagtttatgcaaaggttggg

SEQ ID NO: 108781 - DNA, 180 bp, Homo sapiens
tattgagatcctatcaaacacaagatatacctggggccacaaacaatacaaagacaaataaaacagttcttttctcttaaagagaatatagtctcctgggggaatttagatgtgctttgctttccttcttactaatttacctttacttgattatttaattgactcaagtatgtgggtttg

SEQ ID NO: 108782 - DNA, 1251 bp, Homo sapiens
agggagtatgaatttaatatgggaattcttaaactcctttatgactggaagatgagcatcagagtgtctgcgaccatttgatgatattatgtaccaagttttagatgtttggcttttttcaggttatgaaagcgggggatgagttaagaaccactgctgtgaaggattcatcaactatttttaggcagttgggtaaaaatgaccaatttagttttaagaaactgactgtggctccagagtatgttggagaagtgaaaatggagactaggaataacaggtgggagactattagtctaattaagatgtaattataaatctaagctaggaacgtaaaatgagaatgcaaagtaagaaacaaatatggggaaaattatatgtaaaagtaataggacttggcatcttactgatgtgattgattatgagaaaaatgaagcatgtggaggagtccactggacagtaggaaattcagcctaagacttgggtaagagttctgtggagttgtgaattcagaggccagagatgtgatatttaaaattttggttcaagatttcccaggtataagaaagcaagaggattaaagcattgtaattaaactttaagcagtgcatatttatgttatagataagataaacaagaaatctagggatcaaataggattaaaattagtagtgatcattcagtacagtagttacgtactgttattcacaagagtatataaatcaaattacaaggaattaaggatataaacgtgataagaaagtatgcactgtactctttgaggaagtttgccatagaaaggaagaagaaataggatggtagatcagaagtaaagcaggacccagtggggggagtgtttgcagtgaggcagtatgtataatcatttaaaacatgggtttggagtcctctcaggttccatgtttgtaatggacataatgataataatccctttcatttaaggctgttgtgaggattaaatgtgttaatgtgcaaataactttacacagtgcctggtatataataaatgcttgctacctattaactagtatttgtttctaaggctaatttaagtcctagaattgattgcaaggattagatcaggagtatagtggacatgttgggatttaaatatttaaatatagagatgctttttaggaccattgttagaaccagaagagattttttaccaagttcacacagaaatgtaggtgcattggctgggcatggtggctcacacctgcaatcccagcactt

SEQ ID NO: 108783 - DNA, 381 bp, Homo sapiens
tgagatggagtcttgctctgttgcccaggctggagtgcagtggcaggatctcggctcactgcaacctccgcctcccgggttcaagcgattctcctgcctcagcctcccaagtagttgggactacaggcacataccaccacgcccggctaattttttgcatttttagtagagatggtgtttcaccatgttagccaggatggtcttgatctcctgacctcaggatccacccacctccgcctcccaaagtgctgggattacaagtgttggtcacctctctctacacagtgggatgggtacagctgaaaggatatgatgtctgggattcatttccaaacagtgcagaagctgaggacgtgggtgggaatatcaaaagaacaagat

SEQ ID NO: 108784 - DNA, 353 bp, Homo sapiens
  misc_feature (53)..(53): n is a, c, g, or t
  misc_feature (58)..(58): n is a, c, g, or t
atatatttgggcccctggtcttataagccaagttaaattttgcctaaaataanggccntgccgtcaagcagatcatggtttatttttattttattttattttattttatttttttgagatggagtctcactctgcattccagcctgggtgataagcaagactccatctcagaaaaaaaaaaaaaaaaaagtgttatgtgtcgctgttgttactctttgctcaatattttttttgagcataccactttgtttattcattcttaaattgacagactttaagccagtttctagtttgagataattaaaaatcgagctgcattccagcctgggtgataagcaagactccatctcaga

SEQ ID NO: 108785 - DNA, 719 bp, Homo sapiens
ggatcacttgagcctgggaatagaaaaagagagagagagggagaagcgggggagagagagagagagagaaagagaagtattcttcatgagtctcttgattcttttactggggagacagatgcatttaggtgattttcttcagctcatcctacaggaccagcaggtccctgtttctgaggaccacacacccttgaagaaagctttgcccctttcgtctctgaagatggtcctccagcaatcgagggtgtctgtgtacttgagttcagcctctttgtgcctggactgcatctgcatcccatccacctaggcaggcagatcatctgaggccaggagttcgaaaccagcctcgtcaacatggtgaaaccctgtctctactaaaaatacaaaaatcagccgggaatggccacacatgcctataatcccagctactcaggaggttaaggcaggagaatcacttgaaccccggatggaggttgcagtgagctgagatagcaccactgcattccagcctgggtgataagcaagactccatctcagaaaaaaaaaaaaaaaaaagtgttatgtgtcgctgttgttactctttgctcaatattttttttgagcataccactttgtttattcattcttaaattgacagactttaagccagtttctagtttgagataattaaaaatcgagctgcattccagcctgggtgataagcaagactccatctcaga

SEQ ID NO: 108786 - DNA, 477 bp, Homo sapiens
gtgttaatgtactttacagagttgtagtcaaaagatgattggatgtgtaggattcaaattgctgccttgcctctaattagctctgtgaccctgggcaaaactgtccacttgcattaatgtggaggcacagggacctgaaggtgaagagcaaatcagtgttttctgttttcttatacttatttgttctctcaaaacagttctacttagatttccttagatttaaaaatggggagatatgtgacaagccggaccaggtggcattctgggatttactgagcaatgtgacattgcctatgtcctgacctcaggcatctttgattccacagtgaactgccatttaaccacctgtaaaataaacctaatgtctaattttggaaaattaaagagtaccaccatctttaggatctccttaatctgcctaatccctttatcctctatccatgaaggcagaagccagatctgttgtgttctccctat

SEQ ID NO: 108787 - DNA, 207 bp, Homo sapiens
ccaagatcgagagaccaactggatggaaatagtagcaatagtgacggggttgtgtcgcggccctttgtgcaggattttggtcttcactcataatttgaagtagtaatcgattgccccagaagtgaagcaatgagtctctggtttatttgcccgctttccctttttcctttagcatctgttaatcattttggaaggatgatttgagtt

SEQ ID NO: 108788 - DNA, 677 bp, Homo sapiens
gtttatttggacatcaggtgacctcacaaaacaaaacaaacatttcttgctattgtttctactaaaagaaatgcttaaaagagactgcctgataacatttgggatatcctttttttccactgcagatctcggctgttgtgcttgagcttatttggggcatggatatctatgtgcctataggaagcggagaagtgagcctgagcagtgccacgatttatggggaggcagtaatgagcttctcctgaatgctaattactggagaattgttcagggagacggcaagaactgttggtttgtggtaaattagtcaccagctctattgaggtggactgaaagtttagatcggagctataaaggcaccaaaatcctgatgattgacggccagacttggtgacagtaccaatatggaaataccccaattgtgctaaacagtggtagataactttgtataaatctaatgaaatgagtacaatctatataaaagttaaaacttccaaccacattaggattaaaagggcggtgagactggattgttaaatgaattatgagagctgttttggttcttagatccgaaaagctgcccaagctgccaatggtatgaaagaatagtctgctctggaaagagctcttcctggagtctgctggccttcatttgcctggggatcaagctttctggc

SEQ ID NO: 108789 - DNA, 514 bp, Homo sapiens
acaagcaacattttgcaaaacatcaggctctgcatgaaaattcagattcccacactgagagtccattgagagatctcccactcattagcatgctacaaggccgctgaaagatcaggaagatgtcaaaagggcaaaccttcacataaacagaactcagagaaacaaactgaacttaacttggcatcagccaactgtaagtatgaaaaaaaaatgtgtttattgggatgagaagaaggaaaattcactaatttgtctacatgcaactaagtgatatttttccttggtaaaattaattgcaaaggcagccagatgcagtggctcctgcctgcaatcccagcactttgggaggccaaggtggacagatgacttgagctcaggagttcgagaccagtctgagcaacatggcagaactccatctctacaaaaaaatacaaaaatcagccagaggtggtggtacacatctgtggtcccagctacttgggagtctgagccagaaggtttgcttgagccccag

SEQ ID NO: 108790 - DNA, 303 bp, Homo sapiens
tgttgttggaggagtgggggtgatgccggccctgggaggaacctggccaagtgagctgtccttggtgtgtctgcagccccagctttgcgccatggcccggcacatccccagccctctaagtcagcgtttttaaatgagttgacttaggttgattttcatcttccaccaccatttatctccggaatttacatttcttagtgttttgtcagattccctttcttatagcaacagtctccctacaaaggaaaaaatccataatgacaaatttccatttgtaaccttgggacattctaaaatctatat

SEQ ID NO: 108791 - DNA, 372 bp, Homo sapiens
cagggtgtcacaactggaggtacactgtctgtctttcaatggcgatattattttgatcaatccatgaagattttgtcttattaccatatggttactgtttttttccctttgtatttaagcaatcttgggatacactttaagaccataaaaatatcctactgactgaagtctctccccttagatcaaatatccattgacggtgcttgcctggactaatgtttactgtgatggttgcaaaatttgtatttttttattctagttcattttccacattgatcagtcagcacttgacatcctactctaagcaagactcatacttttttgatgggagtgtaaattcttaacgacttcagaaaagagcaatgtggtgat

SEQ ID NO: 108792 - DNA, 288 bp, Homo sapiens
cattgacctctcttgctactatctccttattcctcagtttcatttgtaaaagttctgagtttcaatcccaatttgagcctggattgcaatgaactaggacttctatgggtgtcactgttctttccagatagctagctttgcatgaactaaatgtcaaatttcgaatggctggatctctactctaaaggctccaaataaacatcaaaacatatgcaatatcaaagcactgaaaacccgcaatagccaactttaaaaaataggtacatctcaacccttagaatttctatc

SEQ ID NO: 108793 - DNA, 302 bp, Homo sapiens
cgacagatttttttctacctaaagcttgagtatgaatagccttttttgataggtgatgaagtgggaggagagggggtaggtatcatgtattaaaggtgccgtatgtcctgtggaagtgtagttactgttgcccccatttaacagacaaggatgctgaggctcccagagcttatgtcagttgtccaaagttaccgtgctggtctgaggtggagctggaacttgatctgcttccaactggacacgtgactgcatccatccaggctttagctgcaagctggatcctgtttctcttggaaagtgct

SEQ ID NO: 108794 - DNA, 461 bp, Homo sapiens
gcattaagaacacgaactaaggaagagtcagatgtcagttcattgaatcacatttaaaataaagcttcaagaattgaggaggggaaaaccgatgtaattttcacattgaggaggcctaaaatgcagaatgtaatgtctgtcttatttttcatatggattatgaaaaaacaaatttttaattttcaaaagttagggacaaatgaaaagaaccctatcattcactcagaagatatgatatttactgtaattctagtgacatagctgtgaaatgctatgctaagtcctcacggggccagtgctggctgcacacttctggcccctgcaaattcaggagaagaaggcagtaagtttggaatcagatggaggagaattggcagacaggttatttgttgtgctttctgctctgtggctgaggttgcagcaaagtaaaaagttgacttttttttctcttttctttcttt

SEQ ID NO: 108795 - DNA, 132 bp, Homo sapiens
ttcttggtttgtctggatttttttttgttttttaagggttccctaccccccattttaagggagagtcttttcctttaacacaatgtaaagaaatctcttttttttttttcatcttccattttctttattttc

SEQ ID NO: 108796 - DNA, 179 bp, Homo sapiens
cgccactcctgcatgacagagtgagactctgtctcaaaaaaagaaaaaagggcaggcctcacgaaggaggtgttgtttgagcaaagcatgaatgtatatgtgagcgagggagtgtgtgtgtgtgcacacgtgcgtgtgtctctctctttctctctgtggccacttatctatgtaagggt

SEQ ID NO: 108797 - DNA, 793 bp, Homo sapiens
atgtggtggtggtctgagcacatagcagagctgccagcgcctgcgggagtcttatgttggtgagggtgtcagcaggggctccgtcaagcccccttccttggctgtagggtttccctggcctaactggtgtttgtatctaacaagagtgctccctccccaacccccaggcccttcttgcttttccacccttctcttactctgctcttgggaactgagtccgttcctcttatgggtaacttgaagggtcaggactgctccccctacaggctctaactgggatagtcactaggtatgtttgactcacgtagatatcaactagttgctgatatttccaaatagtagtatgtcacgtaaaaactagatttctggattctttagaaaatctaatgtgacaatgcaagacctgcatttcctcagaatgctaactggctccagtttgatgtagcaaaggggttagtatagtcatgtagttactcctccctgatatcttaaaccaggccagatttgcacataaatcccaggcctggccctgtggttgtgtgagtttgccaaccctgacccactgggtggtgtggaacttcactggccttcagccagctcaagagctggcactagtggctctgtgaatattccctttgattgatttttgtatttagaacatgtcccaagaaggagacaaattgttgtcagataatttagtatttgctcagtaaagtttctggaatatatatatattccacttctgatgtgagtgagaatgtgtacaacttagtgctattattcgtttaataca

SEQ ID NO: 108798 - DNA, 460 bp, Homo sapiens
ccatgctatactccctttcccgcatttcatcattggtgctgatatgctcagtaaactttcccccacttagtttcaaatttcttctgctttcaatgatgcttctctattcccacttaatttagttaggtgactatctatttcaaaaggtcgcttccagaatatattaaattgtgccagcacaaaggaaatcctgcacctattcctcctctcctttctattctcttttggtttaaatttaataaaaattgtgtttttctgggagaaatataattatatttgcaaatgtaactgagtgtgattgtcttctcttatcaaaagggtacaactctgatgagcaaaaaacagaagagacaaacaggggaaagatgactatcatagaactacagatctggaagcaataatacagatgagagatcagatgagggatgacttatagtattttcctagctcccaattcagt

SEQ ID NO: 108799 - DNA, 288 bp, Homo sapiens
caacatctctggccctgcccccacgatctgggtcataggtgcctggctgcctccattctcccagccttgaaccctcagctcacagggctgtgctccagctgcccttccaacaggctgacaaccttcaggccagacggagaagagctgggcttctccataccacagcaggcaggtgactcactgagagcccagacgagactgtataatccacagtctattggcctctcatcttcaggctcactgtctgtggtcacgagatggtcgcaatcgctttcaggttctcatgca

SEQ ID NO: 108800 - DNA, 514 bp, Homo sapiens
acattattcacttaaaacagcaaactagaaattatataatgggaactagaagaagatgctctcccataaggcagcaggaaagaatagagataagaaaatataaaagaaaactaagatatacgaaatgtagaaataagacttggtaacattcagataataggtgttttgaaaggaaagggagcaaaatgaaggaggagaaatagttaaagaaataataacaaaaaataaagagggaagatttcattttgaaaagacccagagtgacaaatagaagccagaaagaaaacctattcctggactcttaaaatagaatttatagataccaaaaaaaagatgaagaatattttaaagattccagagtcagcgcagacgaccttaaaaggaacaagattctgtagtcccagctactcgggaggctgaggcaggagaatagcttgaacccgggaggtggagcttgcagtgagctgagattgcaccattgcactccagcctgggcagcagagcgagactccgt

SEQ ID NO: 108801 - DNA, 422 bp, Homo sapiens
cttttatttgcagtactgaaatagcatcagaggaaaataagcattgttttggcaatacgtgagaaatatttacactaccctgtaccatctgatattttaggacatctatatagatcaaaataaatcagattgaaaggatttaatatcatataatgataacagtaattactaactaagaaactatcctgtataattcaaggtctccagttttattttttaatacttttggacatgggatagctgcagaattacctccattttccacttcggttttaggagttagttgtgaaccccaccctcacgcaggtacacacataaaaccacccaaataaaccagtttcattaatggtaccatattcaaataaccaaaacggatactggaatgcaatcttcaaagataataaaccacaatgtaaatctgg

SEQ ID NO: 108802 - DNA, 470 bp, Homo sapiens
gtgttaatagcaaaaagaaaaaattggcaacaactgtagtgtatgctaataaggaaatagttaaaatatgtgcattctacgatggaataatggctactaaagagtaaacaccagacatttcaagtaactcaatccaagggaaaataatataacaatacaggccgtatgatgccatttgttatgtacgtaagacgtccatgcacataaaaattatgtaaggacttatagcaaactgctaatgttaacctgggatacagcagaatttgaaaaagcagagaaatccaagaaagtttcactttaattctgtactgtttgagctttctttgtagtgaggatggatttacattatcctgtacaatatttttgaaaagcatgtcacagagctgtaggatcacatgtgagtccaacttgtgagcctcttctcgccttgagggactaagcgctaggacaacagttcactaagtgtggtc

SEQ ID NO: 108803 - DNA, 529 bp, Homo sapiens
agtgagaggcgcaaggagggtgagaagggaaggaacggcagtcaggaaaggggatttcttgagatggctgcaggtgggcagccggagagtcccccgaggagtgtggagaacatgcctcgcagtcgcctcggaaggatggggcattcatccaccaacatccaccccccataggctgatggttgtcccctcaaggtgctggctgtctccaccctgcttccacactatccagcagggctggtccccttctctggctctggagaaggtcctgaaggcagcacagggcagacctcatggttatggaggtgggagtgagtaggcgatgtgcacacactggccctccacagcatgagggcgagaggtgagccgagggcaggggacgtggggtcatgatgtctcctaaaggaacttctcttattgcccagggcgggaggtttcacagcagccgtttcctgggtgtcctgctctcccagagtgctctgcagtattatccttttacctcaggccactgtgtagcaccatgtaaagggtc

SEQ ID NO: 108804 - DNA, 183 bp, Homo sapiens
gtcactgggtctagaaagttaaagggcatcacagctcccatgatgcatgaagacgtagcttcaagcttccttgattctacaaaaggaatgcggaaactccgtatacactagcggcatccatcagagaatcaggcctctgatgagattatttacattaaaaaaaaagtccctcactccccccaa

SEQ ID NO: 108805 - DNA, 657 bp, Homo sapiens
gtcttagtgtttgggatttctcctgagtcatcttaggagaacactaacttatctgttagtgaacaagtaataactaaagcatttttatgtgatgggtaactaaagttttgagactttaaaaaaacccctactttaatggttttcatttattttggtaatcattttctaccttatattgtttattatttatgtgtttcatgtgcagtctttgcttagcaatggggatgtattctgagaaatacataatttggcgatttcatcattgtttgaacatcatagaatgtacttacacaaacctagatagtatagcctactacacacctaggctatatgttatagcctattgctcttagactacaaacctgtataaatgttactgtactgagtgctgtaggcagttgcaacacagtggtatttgtgtatctgaagattctaaatatagataagatacagtaaaaatatgatgttataatcttatgagaccaccatcatatatgtggtccatcattgaccaatatgtcattatgtggtacatgactgtatatgaatattattcaactagattgcatacttcttaagtataaagaccctcttttacacaattttttgccatatagcatagtattattcatgtagttgatggtcagtacatcataa

SEQ ID NO: 108806 - DNA, 301 bp, Homo sapiens
tttatttccaaggtaagtaggggtagactagaatggacatagcagctcctgtcttatttgctttaaggctgcaatttctgttcattctcttacccatgcactttgaaatttcattgctctgcaaagtttccactgaaacatcaggtcgagaagacaaaatgtagagaatagcaaaccaaaaatatactcttcagagagcccagtgatggaaattatattctacgtaaggccattaaccagctacaaagcagtagcagctaactaacctggggataaaagaccatctgctggctgcatactg

SEQ ID NO: 108807 - DNA, 890 bp, Homo sapiens
ccgtatgtgtttgaatggagacagggctgtcttgcatagccattcaggttgaacactgcagaactcctgcggatactatttaaatatatcctttgtagtctcaaaaattactaatgtttaccatattagaaattgaaataatgatattttaaaactattgtcaaaaataaaaataataaatatatgttaacataaatcacattttttttctgaaaaataactattttccaaagcaacagaaatttagtgagaaagaatggcttgattttacacttttgcatatttctttaatgtcaagcttagtagaaaaaaattggattctcatgtttctgaatccaatctgttgtgatacattcttttggttgaaatgtatgaagaatacccagcctcacccagtacttcaataatcttttccaataattgtgattattctcctttgatactgcaccaaaagtggaagttttcttgcttgttgcactgtggaatctagctccgtatcactgactttttttgctttgttacatcaaaatctgtttgtctgttttatattttgaatggatcttttatccatgcctaattttgtaatatcatgcattggtcatttggaacttattggccccttaagtgccctggatcttccaaatgttgaaatatttcattatataatatcaagcactcacagtaaatattagcattaatctaatcagtggtgggtaggagtttttgcttgattttattactggaaacgaatactgtcagttgttttccttgatatgacaggctcactttgttaatttttcaaaaagaaaaagtctactgaaactctagtctagatattcatagtttgacagtcattctttaaaataaaaatgatcctgttctatgaaaaa

SEQ ID NO: 108808 - DNA, 670 bp, Homo sapiens
ggtgagggccattctttctgagatggttccccttactgctttcctctgtcctgatgtgggaatagggggaagggggtgctatgatccttttatgcctgatatgtgcctggtaaagaattctagaactggccaggcacagtggctcatgcctataaccccagcactttgggagttcagggtgggaggatcacttaaagccaggaagttcaagagtagcctgggcaacacagtgagacgccatctctacagaaaatacaaaaaattagctgggtatggtggtgcatgcctatagtctcagctactcaggaggcagaggtgagagaagtgcttgagcccaggacttcagggctacagtgaactatgattatgtcattgcactccagcctaggggacagagtgagaccccgtctcaaaaaacaaagaaaaagatcatggaaacatggatttaatctaaaaaaaataaagattctagaactgggaaggactcagggaatcacccagttcaggcccttcccctcgtccccacatggctggatctacctgatctccttttgggacagataaaccctgtcctttctccgagtcatggagaaaatcagttcatcagcctgtcaccagaatcccagcagctggaactaaatgggatcaggaagctaaggttttcttccca

SEQ ID NO: 108809 - DNA, 700 bp, Homo sapiens
agacaaaaacatttgatctgttaatcatcagtagctgtggtcatctctctttcttaaactcttgggcaatgggtggaaatcagagaccaacttcaaatttaatgtgtaaaaaacaaatagttcagctgcttctattggtaagaaaattcaacttcctaccagccttagaaaggtctctttaaacaatttctttccccctagggttacctagctggtccatacaggttttatcacctcactgcaaggaggaagttgaatattctgttccccacggggatctggcttaatccctagttgctcatatagttggtatcagcatagcaatattttgcataatgctttatttttctcaaatgactattgcatagatgatcttgatatttgcaacagcctagtggatttggtagggtcctgaatcatctctataaggcaaacaaggaaattgtaacacaaagaaataaacatattgaatataattgctattctgtaagacatacagtctgtgtaagatgtatcttatttacagagacatttttgaaaattaaaatattaaatactttttgttatatagagacaatgatctggaagtataaaaagaaaaatattatcttgttgatgtaaatatgatatccttatatatattagaatccaataagatatcatgggcgcaatattagcaaaaaaaagtcagtcttaccct

SEQ ID NO: 108810 - DNA, 776 bp, Homo sapiens
gctatgaggccggggtgaatcggacgaggggcatctaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacaaaaaaaaaaaaaaaggcgacgcggtcgcgaatttatgaggagtagtcggcccggg

SEQ ID NO: 108811 - DNA, 215 bp, Homo sapiens
gtacccctagtttgagaagtttcaatagcagatgatgattcacaagacagtgatgatgaaaaaatgccagatctggagtaaggaatattgtcatcacctggattttgagaaagaaaaataacttctctgcaagatttcataattgagagaattcctgagttgatagctctaattctgatgacaaacgccaatttgggttctgtgctattgaaact

SEQ ID NO: 108812 - DNA, 685 bp, Homo sapiens
gctgcactccaacctgggcaacagagcaagactccatctcaaaataaaaaaggcttggcatggtggttcacgcctgtaatcccagcactttgggaggccaaggtgggtggatcactacagcccaggaattcgagaccagcctgggcaacatggtgaaaccccgtgtgtaccaaaatacaaaaaattagttgggtgtggtggtacgcgcctgtaatcccagctaccctggaggccgaggcatgagaattgcgtgaacccagaggcggaggttgcagtgagctgagatcacgccaccatactccagcttggacgacaaagctagactctgtctcaaaaaaaaaagaataccttaatacatgttccacctaacttaagatagatagctgtgcaactacaaatgaatcccattcttttccttaaccaccagaggtaaccactactcaagtagaatttttaatgtttgtcaaacctgttgcatgaatagctttgcttttctttagggaaaatttagttttaatttccatatgggtttttaggattttgtataattacctataatcttccttttccagaagggaaagatgcttatatttgcattttgcattttttgatatctgtggcagacttaaggtttattctgaagcatacagcattaataattagggcctaacttaacatcattttt

SEQ ID NO: 108813 - DNA, 1850 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108814 - DNA, 1887 bp, Homo sapiens
tcaacaaagtgagttatcatttgaaccaagtgccagaaccttgtggcattatgaactgtcataaaatgtggttaaaagtcttagtagtctgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108815 - DNA, 2105 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaaaaaaaaaaaaaaaaaaaaaaaaaaattttgttgggggggttggccacatcagaaaaaggtttttaaaaccatccgttggggccggcgggccatagcgtacgttgaacatggcgtaaacagaggtcagaagaaacccggtcacgcatgggggtggagtctcaccaataaaaagggcggggcacccggcgtttgaaaactcggaagggtcggagcccaccggccacaacgggccaacggcaataataccgcccgtgg

SEQ ID NO: 108816 - DNA, 1817 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgccggccagtgagtccgtaatcatagatacagatgtttcctg

SEQ ID NO: 108817 - DNA, 1897 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatactccattcagaagagagaagaggggagtgactttgtctttggaaaagcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108818 - DNA, 1599 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagac

SEQ ID NO: 108819 - DNA, 1818 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacaaaaaaaaaaaaaaaaaaaaaaaggggggggtaaagttcctgaggggcaagtatagctccccgtttggaagggccaaagggggatataagagagagggggtaaacgggggaaaggtcgggttttgaagaccttgggggtgattggacacaagaagggaaaatagatgtggctttttgttgtttattctgttatataggagtaaagagaagagaatataa

SEQ ID NO: 108820 - DNA, 1655 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacaaaaaaaaaaaaaaaggcgacgcggtcgcgaatttatgaggagtagtcggcccggg

SEQ ID NO: 108821 - DNA, 1629 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacctactcccgaagatcctgagagtcgccgca

SEQ ID NO: 108822 - DNA, 1518 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaacccaacgagcaggtttgcgactcatatagatcatataggtgtttcagt

SEQ ID NO: 108823 - DNA, 1813 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108824 - DNA, 1760 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108825 - DNA, 1277 bp, Homo sapiens
tcgtaggtgactgactctctccttaaccgaccgaaccagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108826 - DNA, 1800 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108827 - DNA, 1447 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtgccggtccgggttcctagtaacaggagatgctactaatggtttgagccacactggatgtgacctagttaatctttggtgcgcgaaacgctgtgtgggacgcataccacgttgggcatgagggaacagaacagagactagcacagggaaacataacgggagaatcacagaggcggtgggcaaggaaaccaa

SEQ ID NO: 108828 - DNA, 1742 bp, Homo sapiens
  misc_feature (51)..(51): n is a, c, g, or t
  misc_feature (118)..(121): n is a, c, g, or t
  misc_feature (127)..(127): n is a, c, g, or t
  misc_feature (129)..(129): n is a, c, g, or t
  misc_feature (132)..(134): n is a, c, g, or t
  misc_feature (151)..(151): n is a, c, g, or t
  misc_feature (197)..(197): n is a, c, g, or t
  misc_feature (212)..(212): n is a, c, g, or t
  misc_feature (290)..(290): n is a, c, g, or t
agaaagctgtacagtgttgcttgagagatgtaaaagcttaagggtcaaacnataccaattgtataggcttcaaaaaccatctaagttagggcattctctagttttagctaagatacannnngaacantnacnnntcatcttacatgataangtgaagtaaattttttgaaaaataaattttagtggaacaatcctgnaggataacaccagangaatagcaggttaccagtaaggtgtcagccaatttgttccagtcacttttgaatccatgttctataatctaaaatttnttctttccctaagctgagagcttcctatcatgtcagtatctatgtttatacagtgatactttgcaatcagtaaaaacaaactcaaaatagagatgttaacttctttggaagtaaagtaattttttctttatgaccttgaataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108829 - DNA, 1127 bp, Homo sapiens
cggccggccccagttacacagcttgagagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108830 - DNA, 1356 bp, Homo sapiens
  misc_feature (51)..(51): n is a, c, g, or t
  misc_feature (118)..(121): n is a, c, g, or t
  misc_feature (127)..(127): n is a, c, g, or t
  misc_feature (129)..(129): n is a, c, g, or t
  misc_feature (132)..(134): n is a, c, g, or t
  misc_feature (151)..(151): n is a, c, g, or t
  misc_feature (197)..(197): n is a, c, g, or t
  misc_feature (212)..(212): n is a, c, g, or t
  misc_feature (290)..(290): n is a, c, g, or t
agaaagctgtacagtgttgcttgagagatgtaaaagcttaagggtcaaacnataccaattgtataggcttcaaaaaccatctaagttagggcattctctagttttagctaagatacannnngaacantnacnnntcatcttacatgataangtgaagtaaattttttgaaaaataaattttagtggaacaatcctgnaggataacaccagangaatagcaggttaccagtaaggtgtcagccaatttgttccagtcacttttgaatccatgttctataatctaaaatttnttctaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108831 - DNA, 1689 bp, Homo sapiens
  misc_feature (51)..(51): n is a, c, g, or t
  misc_feature (118)..(121): n is a, c, g, or t
  misc_feature (127)..(127): n is a, c, g, or t
  misc_feature (129)..(129): n is a, c, g, or t
  misc_feature (132)..(134): n is a, c, g, or t
  misc_feature (151)..(151): n is a, c, g, or t
  misc_feature (197)..(197): n is a, c, g, or t
  misc_feature (212)..(212): n is a, c, g, or t
  misc_feature (290)..(290): n is a, c, g, or t
agaaagctgtacagtgttgcttgagagatgtaaaagcttaagggtcaaacnataccaattgtataggcttcaaaaaccatctaagttagggcattctctagttttagctaagatacannnngaacantnacnnntcatcttacatgataangtgaagtaaattttttgaaaaataaattttagtggaacaatcctgnaggataacaccagangaatagcaggttaccagtaaggtgtcagccaatttgttccagtcacttttgaatccatgttctataatctaaaatttnttctttccctaagctgagagcttcctatcatgtcagtatctatgtttatacagtgatactttgcaatcagtaaaaacaaactcaaaatagagatgttaacttctttggaagtaaagtaattttttctttatgaccttgaataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108832 - DNA, 1105 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcattatcctcggcgtcggtttatcctcgagg

SEQ ID NO: 108833 - DNA, 824 bp, Homo sapiens
gcagaagcgtatagtcggttctaccatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108834 - DNA, 1059 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcactttgcagcagttggaaaagaaagtgttgtgtgatttgattgaaataaaactaaatgtgttgtcctcctaaa

SEQ ID NO: 108835 - DNA, 1688 bp, Homo sapiens
  misc_feature (51)..(51): n is a, c, g, or t
  misc_feature (118)..(121): n is a, c, g, or t
  misc_feature (127)..(127): n is a, c, g, or t
  misc_feature (129)..(129): n is a, c, g, or t
  misc_feature (132)..(134): n is a, c, g, or t
  misc_feature (151)..(151): n is a, c, g, or t
  misc_feature (197)..(197): n is a, c, g, or t
  misc_feature (212)..(212): n is a, c, g, or t
  misc_feature (290)..(290): n is a, c, g, or t
agaaagctgtacagtgttgcttgagagatgtaaaagcttaagggtcaaacnataccaattgtataggcttcaaaaaccatctaagttagggcattctctagttttagctaagatacannnngaacantnacnnntcatcttacatgataangtgaagtaaattttttgaaaaataaattttagtggaacaatcctgnaggataacaccagangaatagcaggttaccagtaaggtgtcagccaatttgttccagtcacttttgaatccatgttctataatctaaaatttnttctttccctaagctgagagcttcctatcatgtcagtatctatgtttatacagtgatactttgcaatcagtaaaaacaaactcaaaatagagatgttaacttctttggaagtaaagtaattttttctttatgaccttgaataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108836 - DNA, 601 bp, Homo sapiens
  misc_feature (51)..(51): n is a, c, g, or t
agaaagctgtacagtgttgcttgagagatgtaaaagcttaagggtcaaacnataccaattgtataggcttcaaaaaccatctaagttagggcattctctagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108837 - DNA, 456 bp, Homo sapiens
gctcgctaccatttggtggacgagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108838 - DNA, 1356 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagggtaggtttcattttccttttttgaaaagtttgatatttttattttaggtaataaaagatgtacttatttgatgtaaggaatatggctgtgtttttgtttcacagctaagtataaagcctcatgttcatgttttttgtctactcagttttaatacgaagtgtgatcagaatatcagttattaactggtgtagaatcttttgtacttaagagacagactttgcataaattactcacactttgggaggccaaggtgggtggatcactacagcccaggaattcgagaccagcctgggcaacatggtgaaaccccgtgtgtaccaaaatacaaaaaattagttgggtgtggtggtacgcgcctgtaatcccagctaccctggaggccgaggcatgagaattgcgtgaacccagaggcggaggttgcagtgagctgagatcacgccaccatactccagcttggacgacaaagctagactctgtctcaaaaaaaaaagaataccttaatacatgttccacctaacttaagatagatagctgtgcaactacaaatgaatcccattcttttccttaaccaccagaggtaaccactactcaagtagaatttttaatgtttgtcaaacctgttgcatgaatagctttgcttttctttagggaaaatttagttttaatttccatatgggtttttaggattttgtataattacctataatcttccttttccagaagggaaagatgcttatatttgcattttgcattttttgatatctgtggcagacttaaggtttattctgaagcatacagcattaataattagggcctaacttaacatcattttt

SEQ ID NO: 108839 - DNA, 926 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcaggtaagttaagctttttatccaatgatgtaaaatagtcattcacacaactgaataactttgactggcttgtcttttcattgaagttattattaatctttgtctctttgaagaggcttaattctttctttattattttatacagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgtaagtctaaaaattcttttttctgtttactttcatactattaaatagtaagaaacaacatatttacaaatggttttatatagattcacaattacttcttattttctaa

SEQ ID NO: 108840 - DNA, 1581 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggattttcagcccgggtataagctgaatc

SEQ ID NO: 108841 - DNA, 1424 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaatagaaccgactggaatcctctagagtcacctcagcatcaca

SEQ ID NO: 108842 - DNA, 1860 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108843 - DNA, 1787 bp, Homo sapiens
ggacgcgtgggtcgcggacgcgtgggtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgaggattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaatgtcacaggaaaccttttaaaagtggatctgtaatagcatattgtagatgcactttgcagcagttggaaaagaaagtgttgtgtgatttgattgaaataaaactaaatgtgttgtcctcctaaa

SEQ ID NO: 108844 - DNA, 1303 bp, Homo sapiens
ataagggaatcgcgaccacggcgtcgtccccgaccggaggagccgctctttccgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatgcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagcttaattggcttagtgtcgacttcaataattggaaagactgggaagatgattcagatgaagacatgtctaattttgatcgtttctctgagatgatgaacaacatgggtggtgatgaggatgtagatttaccagaagtagatggagcagatgatgattcacaagacagtgatgatgaaaaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtccaatttgttccagtcacttttgaatccatggctggtggaagggag

SEQ ID NO: 108845 - DNA, 1037 bp, Homo sapiens
  misc_feature (1037)..(1037): n is a, c, g, or t
tcaacaaagtgagttatcatttgaaccaagtgccagaaccttgtggcattatgaactgtcataaaatgtggttaaaagtcttagtagtctgcgcggtgcattctggggcccgaggtcgagcccgccgctgccgccgtcgcctgagggaagcgagaagaggccgcgaccggagagaaaaagcggagtcgccaccggagagaagtcgactccctagcagcagccgccgccagagaggcccgcccaccagttcgcccgtccccctgccccgttcacaatactccattcagaagagagaagaggggagtgactttgtctttggaaaagcagcctgcttctgcaaagtggtacgatcgaagggactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatccaaatgattccaagcataaaagaacggacagatcaattttatgttgtttacgaaaaggagaatctggccagtcatggccaaggttaacaaaagaaagggcaaagatgatgaacaacatgggtggtgatgaggatgtagatttaccagaagtagatggagcagatgatagcagatgatgattcacaagacagtgatgatgaaaaaatgcaggatctggggttaggaatatgtaatcactggatcttgagaaagaaaataacttctcggcaagaattcatatgagagaatacgagtgatagctctaaggcggatggcggattgccgactaaggcattgacacctgtgttgtaaagggtcacatggggtgatggcctgggtgggattaaatcgacaggagacttgtctgacatgcggcatcaaagggggacaggttagggaggaatggatagaagccggtcaataaggagagttggaaaggagataagagggagggagagttgatgcagaatgtgggtgtagttggccttggtttggn

SEQ ID NO: 108846 - DNA, 417 bp, Homo sapiens
tctatagaaaacagatataaggttcccaaaaaaattaaaaggcagaacgtactgatcatccagcaatcccacttctaggtatgcagccagaggaaataaaatcactgcaattaaagttatctgccctcccacgttcattacagcattatcacagaattagaaaaaactattttaaaattcacatgtaaccaaaaaagagcccaaataggaaaagcaatcctaagcaaaaggaacaaacctagaggtatcacattacccaacttcaaactataatacaaggctacagtaaccaaaacattatggtactggtataaaaacagacataaagaccaatggaacagaatagagaaccagaacatctacagccatctgaattttgacagaaataagcaatggggaacagatcccccattcaat

SEQ ID NO: 108847 - DNA, 328 bp, Homo sapiens
tgggtggtagtctcctaaaacctgcttaaaggtatgccaaaggcataatgccagcatgtaaaaattcacgagggccccctagaacattgttacatcagttatagactttttttaagcaactcatatatttttttaagtttgcaagctagagcttatagaagagatctactattttatttcctctgtccacttttacttatatatgggatttggaagttttctccaaccttacccagggtaccttttatccataaatgctttcttcgtcatatcccaacatgtagaccactgcctaccctgtttcagttcaatgtccttttgttcagct

SEQ ID NO: 108848 - DNA, 596 bp, Homo sapiens
tgatctcactggaatcaagattaaagttagattttaggttggctaaggaaggtgagcctgtattttcaaaggatatgactcattacctggtcttttttttccccccgagtttccagtttaaggatctgattgatgatagttcctttggttttgaacctttctgcttttgtgttcagtttgtgcttctagaatatagaatttaattgacagttgtactttataaaaaagctcacttggttacttaagatgctatctgcccaatatatagccagtgtcttttctattagagagtagcattcttattccattaacgtgccatgtccttttttttcccatttgactttttataaattccctagaggtcttcattaaacatttatacacttaatattccacaactactctcagttctcattcaatgtctaagaaaatatagatgtatatagtaaaatattttgttgttttacttatttcactctcctcttgtcagtttctagctttactttcatttaccacataccaatatgatagcctactaattttagatgaacttatttgtgtttgtgaaacttgatctcggtcttagaaaattttta

SEQ ID NO: 108849 - DNA, 711 bp, Homo sapiens
gggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggccattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgttgaagatggacttaagtgatattaaaaattcatatataagaaaaaaagagattccattcagttcagagcagaagtggatggcggtgaaatgcagtctgaagactgagg

SEQ ID NO: 108850 - DNA, 331 bp, Homo sapiens
atttatttgtgtttttctctcagagcttaatccatgaggagtacagagtggtggtagggtggaggctagcctttattttgcattgctctgagaagtgttgcgataatgggagaaatttggtgtcctagaaacgttattattataaatgaaaaatcttgaaatacgaggaaagtgaattttttaaaactgggattagaaactcagaacaaaatgagctggacgcgctggtcatgcctgtaatcccagcactttgggagtccaggaagggcggattacttgaggtcaggagtttgagaccagcctagccaacatggcgaaaccccgtctctat

SEQ ID NO: 108851 - DNA, 344 bp, Homo sapiens
ctgcatgctggatctgttcatttctgatagatggatgttgaagtttctaactgtaatagcgggtttatctgttttccttctatcagtttttgcctcatgttttgtgatgctcttttgttagggatatacacattaaggattgttagagttttttggagaattgaccccgttatcattatgtaaggcctaataactttccttactttgaagcctgctttgtctgaaattaatacagctacttgggtatagctacttgtcttttcattagtgttagcatcatatatattcattcatttgttttttattctatttatatctttatgttaaagtgggtttattataga

SEQ ID NO: 108852 - DNA, 366 bp, Homo sapiens
ccattctaggccctcagagaaatccaggagttggtattacctttgttagactgttggtagtttttctcttcttggggtttatcaccgtccaagttctgagtggtttgttcaccaagactcatctctattgagtccattttgcacttctcatttccttggaattgagcttccttagggaaccagagttcacctctaaccaaatgacttgattatggattacgaatacatatataattgccctgtttttcctttcaggctgagttggcaaaataggaaggtggaaattattttggatttttgctcttcttgttgttagatggagtctttcactctgtcgcccagcctggagtgcagtggcacaatctc

SEQ ID NO: 108853 - DNA, 280 bp, Homo sapiens
taaaaatgaacaaagttgagcctgtttctttgaggaaaacaattgacagtacttattgccaatgatgaaatttgagctttcaagcattttggaagactttttgcatctgccacataatcttgccagcttcgccaatacttaaagactttcctgatgagatcagagtgacagtgatgaaagttatatgagaagatctgccttagttttgaaatgaccaatggtataacagaatcatacatgggtaggccaggtgcagtggctcacgcctgtaatcccagca

SEQ ID NO: 108854 - DNA, 2131 bp, Homo sapiens
cctgcgagtccgtcgcgtgctgagggagacgcaggaggtggagccggccgggtgctcgagggaaggacgcaggaggtggagccggccgggtgctcgagggaaggagactggaagctggttccggcgtgagggagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaattgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagctgcttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctagg

SEQ ID NO: 108855 - DNA, 822 bp, Homo sapiens
aactctgtgctccactaatctgtaccctcctggagggcaatgactttgtcttctcaacttgacatttctagcccagctcagcacctggactcactatccacactgtaataccacaaaggcagagaacatattcaccactgctattgccattgcctggcatagggcctggcctgtaggaggcattcatttcatatttgttgaaagcattaataatgggtgtttttaaatatcatactgtaatggtttagctcaggaattgcaacctgaagggcatcatcaagccatagccgtcttttgtatggcctcatagtattttaagttttttgaatttgatacctttggatagagcatgtgctctcctgtttaccactgtttaattgcacagttaatccactctgattatcatgcccttgacctccttactcatctgcgactcatctggtcctgggagatgaggttgggggatgtggggaggggcagtgtatttctttgtttaggctgccataacaaaataccatggaccaagtggctttaacagcagacatttattttctcatggttgtggaggctggaagtccaagatcaaggtgacagcagggtttgtttacctggaggcttttctgcctggcttgcagatggctgcccactcactgtgccctcacacagtcatccctcggtctgtgttgtctgtgtctgaatttcctcttcttatgaagacactggttatattgcattagggcccatccccgtgacctcatttaatcttaattacccatttaaagaccctgtctccaaatatagtcacattgtgagatactaggg

SEQ ID NO: 108856 - DNA, 393 bp, Homo sapiens
tttctgtgctatgccggcctggagaatcctaaagagcttttagactttataatctcaagaatacacaagcacacgaacctgcagcaattatacattaatcaaatgcaatccatattaagtatatcaaaattctgctcattgtgcagtagcctatttaccgtaatatacatgtaatgcatacagagccaggaagtttctgaaattcacaaataaactttgtctgttctttccatccctcttgagtagttggcataacaaacagtataaagaatagcgtgatttgatataaaatcaaagccacttaaaaatacaaatattagtaatcctactgaaaattaaagagttacttcctcccttggaataacagccatataggtccataatcccttgagg

SEQ ID NO: 108857 - DNA, 560 bp, Homo sapiens
  misc_feature (535)..(535): n is a, c, g, or t
  misc_feature (550)..(550): n is a, c, g, or t
gtagatgtgattagcatctacagttagttgactttaagtaaaggagattgtccttgataattttagtggccctgattcaatcagttgaaagatcttaaaagcagaaaacctgaggtttttcttttaaggaggaagacatttcacctgtggactgcagcatcagcttctgcccaagagattccatattttccgacagattctggacctcccaagacagccccacaatcacataagctaattctctgcaatgaattaatttaaatatcagatcactggtgctgtttgtttctctggtgtaaccctgagtatatgttaccctaaaataggcaataaatgagttagaaatttgctataccctcttccttacgtgctatctgatattgcatttcattatgtatccttcttagtgttattaaagtttagagagtgtgtaagtgtgtactgaaaaaaaaactcatttctgtaaaattgtcttctaagtatacagactttttagagaagtaaacagcagacagttaaaaaaaatgctactttnttagagcaaaaccanttttaatccc

SEQ ID NO: 108858 - DNA, 338 bp, Homo sapiens
tccagctgcctgcaatgttggacttgcttctaatttgtcactgcattccctgctcttctatagggatcagcaccagggttagaaaacctctgaaggccgaggcaagtggatcacctgagctcaggagttcgagaccagcctggccaacatggtgaaaccccatctctactaaaagtatgaaaactagctgggcgtggtggcacacacgtatagtcccaactactcgggaggctgagacaggagagttgcttgaacctgggaggcagaggttgcactgagctgagatcctgcctccaacctgggtgacgagagtgaaactcggtctcaaaaaaaaaaaa

SEQ ID NO: 108859 - DNA, 447 bp, Homo sapiens
tcaacttgagcacagcaccagggaggtcagcaagagtgtcccaaacacaacagcaggaagagggaggtgtcaggaatctcgtcagggcccacctcttttctgcaatacaaccgagatcttcctggagattctcagtggagttttggcagcacgagtaatttgtttggcagacagaagacgaccgtctgaggggacgaggtgaataactggaagtccaaaggaggacactggtctccttagaggattattttgtgaaattgcaagacaggcatgagctgcgctggatggtctgagataatttgtggaaatcacacaaacggagccagtgttagcagaggacgaggaaatggcttcctcatacagaaccctttgtcccgagatgggatgctagccacgctaacaggatccttccccagaatggtcttgcagtttccaccctccggaatg

SEQ ID NO: 108860 - DNA, 302 bp, Homo sapiens
gagacagagttttgctcttgttacccaggctggagtgcaatagtgcaatcttggttcattgcaacccccgcctcctgggttcaagcgattctcctaccgcagcctcctgaggaggtaggattacaggcatgtgccactactgcccagctaatttttttgtattattagtagagatggggtttcttttttttttttttttttttttatgagacggagtctctctttgttgcccaggctggagtacatgagctatcatgacgccactgcactgcagccagggcaacagagcgaggatctctggg

SEQ ID NO: 108861 - DNA, 449 bp, Homo sapiens
tactttcccaaggacaaagaatgtgttccctgcctacttagaaggatgttctttcaacatgtctaccttcctggtgggaaccagtttcagaagtctgtaatctcatcaaaggaagccaagtggcagagacgttctccacaggggaagctaatcagcaaggcttcctttctttcttccaagcccttttcattggttttcctgggggctagcttccaacctattgaaatttcccttgatccctctcaaccttcaattagatttgaggaaatggcagtttcccttggtttctttctttcttttaaactcatccttttgaatcaaagagtttagctaggtcttagcacaatgcaacgtcagtctgacatttggcattttgcagtcttggacattggtttgaaacaggtctggctgcagaggcctccaaaatggttaccttcattaagaaaatt

SEQ ID NO: 108862 - DNA, 302 bp, Homo sapiens
tgagagaaaggcgagacaaaaaacaagctaatattatggagtcattgcaaagtaacttttaggcaatgttccgtcatttgtacatgtttccatattgcacagttttcctacttattttttaagtgaatgtatacaaggctgggcacagtggctcacacctggaatcccagcactttaggaggcccagaagggcagatcacctgaggtcaggcgttcgagaccagcctggccaacatggtgacaccccctctctaccaaaaatacaaaaattagctgggcgtggtgatgcatagtagtcccag

SEQ ID NO: 108863 - DNA, 720 bp, Homo sapiens
gcatctgaatattcttaaaccgatatctacagttttccatattgttttatgcaattaaaaaataggtggcacaaataattcatgtactttcttagtttattgttcaattatctttatgtcctttgttagatgacacagtaacatgtttctaatgctagccccttcaagattgaccttctacttcacaatagtatttcaaatcaaaacaaaagaaaatctctcttggcatctttagattagtcacatgtcagattctttttggacttaggaaaacataccaccacctgtaagaggagtgtgctgaagtaagctttgaaaggcagagctgtggactttttactggaccaaatgtttaatattaagcatgggaaggagagattttaggcaactggtcattggctctattgttacagaaagggacaataaaccaaattattacggaaataatacttattttgaatatcagttggtgctaaccaaagttaaaatctttcattcttataaagaaggcaaggtaaataccaatgagctatacaaaatttagacgttcccaaaataccaacaagcctggttaaaagatagatatttgtactgctaacacctgtcccacaaaatgtacacacaaacagatgtatataatataaaatatgtatatttatatactgaaaaattatgttttacaatgttagtattgatagaatgtataggtactatagcaaa

SEQ ID NO: 108864 - DNA, 662 bp, Homo sapiens
acttttttcaatacgtaaacatatatcgcaataatatataaacgtaagattggataaacatatataacaacaacaatatataaacataagattggatgataaaaattttaattactttgtaatgataaaagtctgtagaggaaaccatgattatgttaaaaggatgttggttgtgcataacaggggcaagttgaaatttgtcttactaatccaaggtttacaggtaagcttattgagtgttactcctaagacatgacaagtgataattattctttgggccttttgcgaagtaaaataatgcatgaacatagagtttaatgtgtttgggcaacaccgcgagccccttctcccaggacggagctgggcctctgtgccttttgagttgttcctttgctcaatgagtgttccacagagaatgggacagaacctgctccctgagcacaagctgagggaggtgaattaaagtgcatttgcattcatgaggaaggatctgctcatccaggtgctctgtcctgtcgccgttagacgctccttggtccctcaaagagatgtcactctcacggccactgcattgcaccacctgtgagatacctttggaattgtggaaagttcagctagaaagttgtttctttttaatatttattcttttggtcccaaacctt

SEQ ID NO: 108865 - DNA, 857 bp, Homo sapiens
tgagctctgtgtctccagcacttactgttcatattcttatgataggttggcataggaaagaggagaagagaggcaacctttaaggagtaaggaggagagagtttgttagagcaataaatgaatgttcttatggattcttgtagtttataaagttatttggaagaccagcttgagtttgccgcttactcttagtggcactcaagtgtagctgtaaagactgggatctgtttttaagtgcctagaaaactctgtgtttatggaatctgcatctgttggtgaagtttagctcattcatcttagacctcaaacagccctgaagaacttaatgcttacatctggttaaattctcagtgtgtagtttgtacgtttttccacagctttaagtaatgatagagaagaaaagaatagagaatgaatctcagagaaatgaaagcaacttaggaacagaaacagagaaacagtaagaaatgcatttttcagagactgggccaaaggattcatcatggagttttaacttctagcagaaagttgaggaaaaggaataagactcttttctgaaccatacaaagccccgcagctcctgtcttctggctgacatagcaccatctttacccatcacacctgtggcctggaaggtagcctctctgtacctgaatttcttcatctgtaaaatgggattaaaaaaatcactgccctcatctatgtgaggatcacgtgaaggccaaatgaaattacaagcctgagacatctttaaatgttgaaagaagattacaaacattgggtaatcatcctctcctatgtgtatcattagacaaccttgctttggattatttgttttgttggccattcttagatca

SEQ ID NO: 108866 - DNA, 804 bp, Homo sapiens
atcttttgaaaaaagaatagaggactttaattgcaacttaaataattttttttatttttccctcagaatataatatgttcagtgggcacgttaaactgatgataatgtacactgtgtctaaacgaagtaaatctactttagcttatactaacagattcaatttgaaattatgtttaggtaaaatcagaattaaatgtatcttgatcacagggattaagtacagtatcttactgtgtaacttgtgtcacttgtgtatctggtaggagtttatcttctacatggagtttcattactgcctctccattgataaatgagcatctatagatgtagtttcacgggaaaaaatattaaatttatttgctgtcagaatagttttactgttacaatctatgtacccaggtattcacttctgagaagtggatactgagttttcaaatgctgataacttttagttggtagtatttattggataggggaccaaactgatttttttatgtgttgaattggcacaaatttgtgaaatagccactcagaactatcagtttgaatagaaatatatgataacatttgcctaaatagatcttctatatttccaaaatttgaaaacttgtataagttttacctaaaagtgtaaataatcaaatcatccttttaatattattctgaattctaaactggaatgtcaccaagtaactttgagtaatgaaaatccacatcaagaagaatataactatttgtccttaatttctttaagaatgtaaaaagcttttaaataaagttaaaaagacttccagtaataaaagt

SEQ ID NO: 108867 - DNA, 402 bp, Homo sapiens
gtctctactaaaaaatacaaaaaattagccgggcgtagtggcaggcgcctgtggtcccagctactcgggaggctgaggcaggagaatggagtgaacccgggaggcggagcttgcagtgagccgagatcgtgccactgtactccagcactccagcctgggcaacagagcgagactccgtcataaaaaaaaataaaaaaataaaaaaaccccaacaaaaccaaactgagagcttctcaatttgtagtcagaaagattaaaaaacaattaggctgggtgtggtgctcatgcctgtaatcttagcactttgggaagcctagctaggaagattgttcaaggccaggagttcaaggccagccctagcaacatagtgagaccccccctcatctccatacaaaaaaaaaa

SEQ ID NO: 108868 - DNA, 2331 bp, Homo sapiens
  misc_feature (45)..(45): n is a, c, g, or t
  misc_feature (358)..(358): n is a, c, g, or t
  misc_feature (617)..(617): n is a, c, g, or t
  misc_feature (643)..(643): n is a, c, g, or t
tccatgatccagactcagcagttgtcgcaccatgtctgacaaacnctgtattccttgacagagctttgataacgtaccatatgcagaaggagttattcctgataaggctaaggcttgtctctgttggcaccagctaatgcaatggcaggtcttctgcttggtgttgggctcctgcctactcctaacccacttactcagactggcgctgttccaccggctgctttgggggctcctactcttgttcctgcccttgctgcgcttgggcttcctggagcaaacttgaactcaatctgttgccacagatagttgctgaagcttatgagcactgttggtcccaagttgaagcatgtagctgctngtcttgtttcaccaagtctgaaatcggatacctctagtaaagaaatagagaaaggggccccacatggtggctcaggccagtaatcccagagctttgggaggctgaggagggtggatcacttgaggtcaggagttcgagaccaacctgaccaacatggtgaaaccttgtctctactaaaaattcaaaattagccgggcatggtggcgcatgcctgtaatcccaaatacttaggaggctgaggcaggagaatcgcctgaancctggaggcggaggttgcagtgagcngagattgtgccattgcactccagcctgggcaacgagcacaaaactcttggctcaaaaaaaaaatagaggaagctatgaaaagagtacaagaagcacactgcctaatttcggctgctatagaaccagagaaagaaaaaagaaggcattcaagatcacattctaggaggaggaggactctcatcttctagacacagtcaaggagcagatcaagagagtgattacattgtcagtctaggagtcgttgatgattcaaaagcccaagacagagaagatctcattccagagagagaggcagaaggtcaaggagcacatcaaaaacgagagacagaaagaaagaagacaaaagaaacattcaaaaacacccccagaaagttacagcacggctagacattatagaagtacaaacagagagacaacaacgaagaagcaggagtggaacaagatctcctaaaaagtctcggtgtcctaaaagaaaattgtctctctcaccatcccctgggaaacataaaaagaagaagaaagataaagagagaaataggtatgaaagagaacgatcaacaagcaagaagaagagtaaagatagggaaaaggaccaggaaagaaaatcagagagtgatacagatgtaaaagttacacgggtttatgatgaagaggaacaagggtatgacagtgagagagaggaaaaaaagagaagaaagcaatagaagcagattcccctaaaacaaagaaacgttctgtggaaaagggaactggtgattcactaggagaacccatagtgaatgggaatgatcatcatgaagaagacatggatatgagtgactgaaaattgcctctatgggaatccagctgtatacatgcatcagtgtcattgctttgtgtaatttctgaatgttgtatttgttcatctcaaccctagatgtatatagctctgagttattaatggttataaagctcttgttattgatattacctatttacatcaaaaagcttttagaaaatggtatgatgtaagcaattcttgtcatggtgaaatctgatggtgtaacccgttttactattggcgctgcttcataacaaaaatgaaaagctatatacatctacagccagaatggattgtttatgtcatataatttcctttactaagttcacttacattacttacagagttttattcattgccataatagagccatgtaggaaatgcactgactgcatgttattgtggcaagaatatcctaaatgtcattaaaatcctccaacatgatggatctacttatggtcttgtttgttgacatgccaaattaacatagttccatctggaaatgagcatttgaaatgataatccggctgggcacagtggctcacccctgtaattttagcactttgggaggccgaaggggggcagatcacctgaggtaaggagttccagaccagcctggctaacatggcgaaaccttgtctctactaaaacacaaacgcgcgtgcgcgcgcgcgcacacacacacacacacacacacacacacacacacacacacaaaattagccaggcatggtggtacatgcctgtaatcccagctactccagattctgaggcaggagaatcacttgaacccaggaggcagagtttgcagtgagccgagattgcgctactgcactctagcctaggcgacagagcaagactccatctc

SEQ ID NO: 108869 - DNA, 310 bp, Homo sapiens
gaattccagagactgagccaaagaagccagagaccaaggagtccctactgcatgctcccccaacgcaaaaaccccaaggaggcaaagcacccaaaggccttagaatgagaagagtgcttacccctgacatgggtggggcactgatggggaaaggacagtggggagttttacagaatgagaagagcgcttacccctgacacgggcggggcactgacggggaaaagacagtggggagttttctaggttgctagaaatgttccatgtcttcatcttggttgtgctacttgagtacaaaaactaacctgcctgg

SEQ ID NO: 108870 - DNA, 347 bp, Homo sapiens
gtggttcactttggggcctcagcagtcatgggcagacagtggctggggtcactgcaaagacttccctgcatctctggcagttgatgctggctgtcatctgagacacctacccagggcctctccctggggcctgggctcctgcttagcttggttgggaggctccaagaccaacatcccaagaaagatgagacagaagccagatcacctttttgggcctggcttcagaagtcacccagcatcacttctgctgcatttatttcttagaaacacagaatatcagaccccatctcttgatgggagggggcctcatggtttgtagacatgttctgaaactccactctgcccgg

SEQ ID NO: 108871 - DNA, 458 bp, Homo sapiens
atgaccagaatgattgccctgatgtcaaggagggagcaactggtgtaagaataaggatgctttatgtggttcactgccttacttattaaaattcactttatttattaagcaacatggccaggaaactggctcagggagtccaagtgaggctttcctagttgatagacaggaaatgggggatccaggctagagctcctggctcgaggctgttttcacgttgcccagctgtctctgaattccacattcctcagcagtcagccccacaactgccgacctcggggttggacatgaagatcattctttgggccaacagtgtagcagatttctaggtaaccaagagaataggaaggtacactatttcgatgttggcgggagctgtcctaacagacacgtgcctggtgataatgccgacctctccttttataggcctagtgttgggctggtgctagatctgatct

SEQ ID NO: 108872 - DNA, 3510 bp, Homo sapiens
caggaagaggtatttcttggggatgctaccaaggcagagactgtgaagaaggaagaacgttgcttgggcaaaaggagcatattctcaggagacggggcccctgcctgccacaccaagcattaggccaccaggaagacccccatctgcaagcaagcctagccttccagggagaaagaggcccctgcagctccttcatcatgaactggcacatgatcatctctgggcttattgtggtagtgcttaaagttgttggaatgaccttatttctactttatttcccacagatttttaacaaaagtaacgatggtttcaccaccaccaggagctatggaacagtctcacagatttttgggagcagttccccaagtcccaacggcttcattaccacaaggagctatggaacagtctgccccaaagactgggaattttatcaagcaagatgttttttcttatccacttctgaatcatcttggaatgaaagcagggacttttgcaaaggaaaaggatccacattggcaattgtcaacacgccagagaaactgaagtttcttcaggacataactgatgctgagaagtattttattggcttaatttaccatcgtgaagagaaaaggtggcgttggatcaacaactctgtgttcaatggcaatgttaccaatcagaatcagaatttcaactgtgcgaccattggcctaacaaagacatttgatgctgcatcatgtgacatcagctaccgcaggatctgtgagaagaatgccaaatgatcacagttccctgtgacaagaactatacttgcaactctttttgaatccatacaggtcgtctggccaatgattcttttacttacctatctgtctaccagtagcggtccttgcccatttgggaaactgagcttctttcttctgcactgggggactggatgctagccatctccaggagacaggatcagttttacggaaacaactcagttagtatagagatgaggtccgcttctgtagtactgagcatttctgactgatcaaaaaggcctagtctgttgacagggtttgttttattttagcctcagagtataccatactactagggagtaactgtagagtgagaaattataaacattatttagggattaccatggtggaagagggataaacataggtcctgtgacttcgtctctgttctcaagggaaccccattcacatgcccctcctaactccacaagcgagggtagcagaggctctcctcagtctgaactaaggcttggccttggggagggctcctagtgctgagcttggagcagcacggacagcagcattgtttatgggaatggagagaggtctgggcaggataggaaccttcttggagacccctttgaagaaaaccaggcagccaagggagccaaacacactagatttctgttcttcagcaaagccctgaagagacacttaagctaaaaattcccttgtcatatttctgaaactccattataacatatgtaactcctttgtaaccaaaatttaggtaagcaggcttcctttgctctgaaggttttgagtacctggctgtatttgttgagtatttttaaaattttggatagtctcttaggcaacaataatcacaatatattcatcccttcagttctggagaaagcctgataccagcacagcctactgaccccaaggagcctggcactgattggcatcacattgatctaagaactggtccagccgacgaagagtaggaaaagagaagggctgctcagggaaacattggctgggggcacggaataagcacatagtaaaaagggaacatcagggtcaaatggaaatcacctgagacaggaaacagggagttcatttggccacactggaagaaaggcaagaaagaggaagacaagtcttggggtaccctggctgttctccacactcacaagacatcagctatatactctgcttggtgcataagagagagaaaagagatgccttttgtgttttgagtaagaataattaaaccataaggaagaccatgtataaaactgatggaaataatagtcaccaaagtacagcacataccattttgtgtctaataacaatgtagcacagtaatgactgtacatgtcattgtatgtataccaaacaagattgttgtaaatcatattttttattacaacactaagttctgcttctgcattcctaggtttcatcatttttggctccttagcatggccacttacaattttttaacatgagataacacatcaggtgtcagaacttgcttgaagggaattaccagaagtaatttgtgtttgagatggggtggaaattggaattatattagtagccggtggagatacaagttctctgactgtgttgggaaaggataagtgctaccgttgagaagggaagaaaggctgagtctaggtggagaaaaatatcaacagaactctagccaaaggcaagccccagaactcagacaacagaaaggaaatcctaatccttctgttttgagaagagagaactgtagttgcttcacttcctatttcatgacagaataactgcaaacttttaagatcaggaaatgtagacatctagtgatttctttagtagacagtttaatttcccccaagattaggagacacttctgtgcaggttctaaaaggagcccaatggcctggggtgggagtggggagtagatagggaatatgtgggatttggtttaagttcatcattgggagagttcctggatccttgcaagcttagataaatgtgatctttattagatagcagtggcatgcttttaaaaaaaaaaaggcaatgaaaatttagcaagccactgaatttgagttttcactttgtttctaatatgctgtgtgaatcagtacagttttcttaccctttcttggtcttaatttccttactgataaaatggggtagtaatacctatctcaaaaaatattgcacatattaaataacattcctctatgtatctcaatggcattagacattaggagaagcattttgtggaggatttgaagttgagatcttcatccaagaagtagcttttcaatttgctagaagcttaatgtaggcaagccacttcatttttcagaacttgtttactcatttataatatgggaataaaaatttgtgcaagtcagagaagggtgccttaaaaatgttgtggccaagccacatgagatcaaagacacacttttcatgacctcaaatgtgggcccagcctaggtcagccaacccccatccaacccttagactcacgaacaaatccacctgagatcagcagagccaccctagatcagctgaaactctaagcacaaaaataaaaacttatcactgtataccactggagttttctggttatctctcgtatagcaaaatctaactgatgcaatctccatctggccttcatccttctccctttattgtcctttcgtgtattgttcatccagcaaccaggatgatcttgttaaaacattaaacagattctgtcactctt

SEQ ID NO: 108873 - DNA, 738 bp, Homo sapiens
tagccacaaataaatggagatagccaggttgggcatggtggcttatgcctgtaatcccagctctttgggaggctgaggcccaggagttcaagactggcctgtgcaacatagcaagaccccatctctacaaggaaaaatgaaaattatcccaggcatgatggcacacacctgtagtcccagctacttatgtggctaaagcaggaagatcacttgagctcaggagttcgaggctacggtgagctaggattgcaccactgcactatccagcctgggtgacagagcaagacgctgtctctgaaaagtaaaataataaaataaaaggagatagccagcaataggagaatagaatataatccagctatttagaatgtttccataattgatgaagaagtccataccttataacacgtgtgaaaaatatatagaaatatacacacattgtgtttgcagctgtgtaaaaaatacatagaaaaagtctaaaaggggctgggcacagtggctcactcctgtaatcccagcactttgggaggctgaggcagacagatcacttgaggtcaggagtttgagaccagcctggtcaacatggtgaaaccccatctctactaaaaataccaaaaattagctgggcatggtggtgcacgcctgtaatcccagctactcgggagactgaggcacaagagtgactggaagctgggaggtggaggttgcagtgagctgagattgcgagactctgtctca

SEQ ID NO: 108874 - DNA, 785 bp, Homo sapiens
  misc_feature (19)..(19): n is a, c, g, or t
  misc_feature (267)..(267): n is a, c, g, or t
attctagaggccgaggggngtcgacgatgctcatgtacgtttatctgtattcttgtgtctattatgtcttgtggtcacgtgatggaggtagcgctcgagatcagtagtatcttacaggcatagggatgtgcctacaacaccaagttattacacggcacagggaatagatccgatgtcgttttctgcaacccaaattggagactgagagtgtactagtccgatcatttcacatgagaatactacttggaacgaccgtgtatcaccagntggtgccatacagaatcctacacttctaaacgttcgcacgttacccgatatacatgtaaaaactaaaatgtgtaaacttctcagaagaaaacatctgtgtagatctttgtaaccttggcactggtttcatagtaccaccttaaaagcacaagtgacaagaggaaatataggtaaattggactttatcaaaattaaaatattttgtacttcaaaatacgccatcaaggaagtagaaaagtggccaggcatagtggctcgctcacacctgtaatcccagcactttgggaggccaaggtgggagaatcacctgagcctaggatttcgagaccagcctaaacagtgtagtgagacctcgtctttataaagaatttaaaaatttgcctggtgtggtggtgcacatctgtagtccaagctgcttgggaggctgaggtgggaggatcactggtgcccaggaggttgaggctgcagcaagtggtaatcatgcctacctgggcatcagagtgagaccctgtctccaa

SEQ ID NO: 108875 - DNA, 511 bp, Homo sapiens
aataaaacaaaagaggcctactacattatatttaagaaaactgtataatgtggaaaaatagaaaaccataatttatcatttatattttctcaatgtaaaatatttagcctttcactctaggttttatattataaaaacatgtatgctcagagacttaattagaattagctaacagacatgaaatataaattttttaaatactgcacaatgttacatatatttatatggatatgcagtacagatatttttattataataaatcaaaaataaagtgagtaaaaacatttcatcagaagttgtgctggaagaagctggcttttagttcaaacaggagaattacattattctaattgtatactcttactctaatctttttctttcggaattaagccaggatagtccaccagctttcactaattattaagtaaaaagactatttttaaaatttgtatattggaaacttaaggaaataaaactgaaaagcaactgaatctgaattttaagagatatt

SEQ ID NO: 108876 - DNA, 685 bp, Homo sapiens
ttgaaattactgggcttctctgtatcccccatatcagtgagatcaatggtccccattgcttttcaaatggaatgaaaaaagtaaagaattaactcattgagtgttttgccatataaaggtcacctacttaatatctatatcctttatcattttgttttgtttggttcttgtttttatgagtcttgtattatttttttgctttttgctattattatgttcttacttattaaaaaggtaattaatattttcatattgttagacacttaaacccatatttaagaattactgtgatctaattaatcaggccgtagtggttcgcacctgtaatcccagcctacttggggagggctcagggcatgagaattgcttgaactcaggaggcagaggttgcagtaagccgagatttcactgctgtactccaccctgggcaacagagaaagactctgtctcaaaaagaaaaaaagtattactgtgatctgaagtttttaagtcaggatttcattctagacaaatatcttaactaagcctataaaaaccttactttttatcctgtcagttccaagcaaattcaaactggttgtcacaatgctttacataatactaaattatctgtatacaaacataaacgcgtatgatttttattctctttaaaattcaccatttacatggaatataattatatttc

SEQ ID NO: 108877 - DNA, 471 bp, Homo sapiens
gtgaggagacaatcttgataggaagtttgaactttgaaataatattttattctaccacccatctaaaggctaattaatcacaaatgttaaaccaatcagaagaaaatgtttgttaaaccagaaaaggctgttacctctcacagacaagtttctttctttaggtcaacatatctggtgtagctgtcaggattcagagcaacctcctcacaccctggaccacctagtgatccctcctggactcagcactcagcaccagcacaaacctactgtgtttctctgtctccacatctttccctgagtacaaaaggtagccctgcgtgagtaggcatcttccatcatcagagatctccaacttgaagctggacctgcagccagttcacctgggttcttcaggaccaggggcaaggaaattgaaactcagtttaaaaagatcactcaaaaggctaaatggctacaagatgacccatggtt

SEQ ID NO: 108878 - DNA, 568 bp, Homo sapiens
aagctaaaatcaaagaacaatgaaggaagggagaagaaacacttttttctacttttatttggataccattacaaatttagttttagagcatattgatgaaaagaaaaatgaatctttaccataattaataatatataattaaatattttttatccactcatgtaactaaatgaaaaagaatgcataaaaacatgacttcttaaagtacatgcaaatgtatatgcatgttttatacataagcacattctatacaaaacataagaaaaagaaagtgttattttgagaatctctcctttactatatatgactataacatgttgggtaaatattttatttcataaaatagccataatcttatccattcaccatatattctctcttaatactatggtatgggggtcccctgcgaaggtcaatggatgggcccaaataacaaattctggcaatattaacttttggggtcccaaggttttttcccctcttttcacccaaagggaatccccccccccttttccccccccatggaaggtttccttggaaactggccatgggtcctttcccggattcc

SEQ ID NO: 108879 - DNA, 366 bp, Homo sapiens
ttctgttcttctctcactctcccctctgcagtatttgccgccgactgctgctccctccttcctcaatgctctccttccttggctctgatggcaccacaccctctggctttccctctgctcttctctcttctccttccttctcagtctcctctgtatgtcaccctctgttaaccagcccctcgattttggggcctttcaagtgtctgtcttggacctccttttcctttctctctttctcattctataggatctttctggaatatccatctctttccaagggctcaatacacatcgatgggctcccaaatttatactgccagctcagatttcttttttgagctccagatctatatttacaactgctta

SEQ ID NO: 108880 - DNA, 353 bp, Homo sapiens
acattcaggtacttaacatttttaattctcatcccaaatagtggaaaattgaatgtgagggctatctggctgtgacatgttaccccattgatccccagggttgattcagctcatctggctggctcggcaggtgtccccttcctccctctccactccacgtgcgtccctcctgaagctgaagctgcgtgcttggttgaagaggacaaccatcccaaatagaggaggactggtcttgggtcaagggtatacgagcagctgcgctcccctgctagaaccttcgagcaagctctcaaggtccaaatagtggaaaatgaaagtacaggttgattcatgttggcaggttttggtatcaa

SEQ ID NO: 108881 - DNA, 370 bp, Homo sapiens
gtgtgatctgttttaaggaactggaagaacgctactggtctgtagaagctgctgtccagtattgtgcacgttttggactccagagacagagaatgtagtagtagagaatttgcaaactaactctgactctagtaattcatatcaagactttatgagcagaaagttggtatacttgctttctacagcaccccaccccctctggtaaatttttttatgaaaagtgagactcatttctacttctacattgggtgatttacttaaatgaacctttccttcaaattgttgcactgaattcattacattaaattcaacagtttattgcacctctagtatttgcaatatgtcatggaggcagatcttggtttagagt

SEQ ID NO: 108882 - DNA, 228 bp, Homo sapiens
ttccgggttcacgccattctcctgcctcagcctcccgagtagctgggactacaggcgggcaccaccacacccagctaattccattttttaattgagttttttgttttgggttataggagttccttatcatggatggactttcataatctcttccctttctccaacccagtaaaacccatatatttattctttgcttacttttttgtgtgtaattgaattttttaaaat

SEQ ID NO: 108883 - DNA, 323 bp, Homo sapiens
aaatagggccaagaactgagtctgttgacctgccagttaaccaggagggagaagaaagaaagaacaatgttaacactacaaagttacaaaggtaggggattctcaagagaaggatgtatttcatcagctcagggagaaaagaatttcaaatcaaatgttgagaaaccaaggggaatgacttggaaagcaattgaatcaggcaattaggaagtcggcacttattgttaatacagcaaagtctcagatttgatatccaaatatttcgaatgtctttgtttgggtaagttagtctctggcatagctgagtgccctacacaatactg

SEQ ID NO: 108884 - DNA, 787 bp, Homo sapiens
gaaaaactctttttccctcctgcttttctgtctaagagtaggccataaatttccatttataaagttgtctgcctctctactaccaggaaaggatctacttggaaatatctcttgaggacgcttatgcatataacacaccttactagacaacccttatttatcatacgtttcctagcacctttcctaacttcccccctcacccctgttctccacaggaagccccataccccctttcctttgtgtagcctcttcacacttaatcacttctgttacgatggtataggtcaaaaattctaattgcctccttgagtcacatttatttgtgaaggctttgtgtacatatgtaattaaatgttttttctcttgtcagtctgtcttttatcagtttaattctcagacattgaaggtaagaggatagaggaaaagtgtttttccttctttacactattctcctcataaggtcatacttaaataaacttcattttctttttgttttgtgagatttttgtttcctgtgatcatccctactccattcttttccttgtttgcctttagtgagtccctgttccttgccatccaaggcttcatttacaaattatgcaaatattttacaacaaaagaaaacagatattatgacttgatgaactatgaagagtaacagcctaaagttttttttaataagtaaatagtagaaaatgaattacctatctagtatcaaattgttgccaacctgagttaggcaaaagaattttttttagtgcggtgtctctatcccctactctcccat

SEQ ID NO: 108885 - DNA, 433 bp, Homo sapiens
ttaatttccgacttaagtatgaagaaatagtacaggtggcaaagcactaccatccataagtctataaaatataaaatagccatattagctaaataaagaactcttaaaattttcccaggaatttcatttgaaacaaaacatgtagtttttcttaagcttttggactggtaagtggcatttatgaaagaaacattccttctagcaaactaagatgtgcttctctcttgcaaagtttcctgcttttcgccattgaattttaaatcattcttcaacaaagcctgtcaagaataagtaacatgatgtcctctttagtgccttccactccatccaattaccatctcaatacttaatattgatgattgggtgcatccatgattctgatcatttcttactgtggttgatgtgtccacttatctagatctgtgtacccttt

SEQ ID NO: 108886 - DNA, 257 bp, Homo sapiens
gtttctgtcagtttttatttctttgactgagtcatactttcctgtttctttgtgtgccttgtgatttttgttgttgttgcaaactggacctgtgatgatgagaacgcagtagctctggaaatcagattcttctcctttccttgggtttggtggggttttttgcttgccaaaggatataggggcccttttatttaacgacttttccaagctattgttattgcagactatcttccttcgttatgtagtcactgaagtcc

SEQ ID NO: 108887 - DNA, 220 bp, Homo sapiens
gcaggggtctctactgtccagaaatcatgtggttactcatcacggcagctgctactacagacactgaagaaagatcatccaacatggataaataccctgttcttatcagatgtttgagaagtaatagagtataatgatgcccctcatgtagaatatggttctaagaaacccatacttatattaactcagaaactgccataaatagctgaaatatccaaat

SEQ ID NO: 108888 - DNA, 152 bp, Homo sapiens
taaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgaca

SEQ ID NO: 108889 - DNA, 338 bp, Homo sapiens
atatgtgtgtcactattccaaggaatgagtagatcacactttatttttctgcttcttgtgaacattaattagttcagttttctgaaattttcaatgctattgtgattttttaaaattaacaatgctactttgcttattgtgtacttgtcaccagaaatgcaagagctaagatgtctctggaaatggaattcctgggtcacagggttggcacatgatcaacattattagataatgttaaattgttgtacaatgtaatcacattaatttgtatgccaatagtagtatataaaagtttgaattgccctacatccaaactcacacaaaaataaatgcagtct

SEQ ID NO: 108890 - DNA, 759 bp, Homo sapiens
gttcccacccaaatctcatgtcggactgtaattcccaatgttggaagaggggcctggtgggaggtgattggatcatggaggcagattccccccttgctgtacttgtgatagtgagtgagttctcacaagatctggttgcttaaaagtgtgtagctcctccctgtgctctctcttcctccttctccagccatataagacatgcctgctttccctttgccttccaccatgattgtaaatttcctgaggcctccccagttatgcttcctctacagcctgtggaactatgagtcaattaaacctcttttctttataaatcacccagtttcaggtagttctttatggcaacgtgagaaaggactaatacagccacgttattcaaattcctcagggagctttgacagagttgttcctctaagccaggacaaccattcccttgcacaccatgcagaagagccattaggaacagtgacctttctgattgtctggggactgagccagagggtgacaccatagggagaggggtaagtgagagaggacatttgctggttggctagagtttctcctgagcatggagatacccctgctgggactcccagagatatttggaaggaggcagtagggtctggtggtagtggtttaacagagctttctgcaggatgtttaacaaggagatgccacaaatccacagggcctaagccgctattctcataagcactggcgggaaaatgagaaggaagaggaatatgagagaggtactgc

SEQ ID NO: 108891 - DNA, 770 bp, Homo sapiens
tatcattatctagcatatattgtaaaatcctgtttggtgggctcagttggaccacataatgagcataattcaaggtgagagatggaatagtgggtcagtttttgcccgggcatgccaagcttccctgcagggttagtcaagggatttgcctgaaattctaccattgtttggcttgttcccctttcctgtcctgtttttctctctccctgagagtattatcttaacaaatcatttgcttatgaattatcacctcaggatttgcttctgaagatccggattgtgttcgtttgggtctacatagaagcagacacagatacattacaccatacattggatgtgcaagagatttactaaggagagagcaagagcagggagggagaacttgcagacagcagtgcaggtctgacactcacaggaggagaaaaggaaggaatgtggattgggtaagaagtttctgggtacagtgcaattccaagaaagggttggctttgcaaagagtcctgcagtttgtcagaatgggcctgtactagtacctttgccatcctcattcattgactgggaccctcagaaagcatggccttggtgcaaatgtggtggttgatccagagggtagcagcttgagctgtcagtcaactgtggtccccgcagctgaagatctgagtagagcattatcatggccaccacactgccctaagatactaatcatgtagtaattttttatttgtattcagaaaatattttctttgtttattctcaacaaatatatgtga

SEQ ID NO: 108892 - DNA, 177 bp, Homo sapiens
tacaaatcttagaaaggtggatttattttttgttgcctcattgatttcactaaaacttgtttcaaaagaagtcctttgttctcatgatatttttaaactgtgggtccgaaggaccaatggtattaataatacactatattatataatatacaatataatacaataatcataaaaaac

SEQ ID NO: 108893 - DNA, 171 bp, Homo sapiens
caactctagatttgctgttcatccacctcaccctacgggacaactgcaggatttgtagcatcccggaaggtgactatcttaaacttgaacggtatttcagtgatttgtaagctcaataagtgcaaggttcacatttgttttgtgtaccactgtgtatctgctatccagcac

SEQ ID NO: 108894 - DNA, 511 bp, Homo sapiens
gcggccgcctactactactaaattcgcggccgcgtcgatttgagctcctcagaagaaaggtgctccaggcatctgagagaataccgttggggtgatacttacaaatttgtaagctaacactgaaatcttaaaacttccgaaaatattaatgcatttgtatgacttatttttcaactgagtatgtcaaagtactttatgaacaagtgttgtccctagtttgtactgatggggaaactgaggcatggggtgataaggtgactggcccaaggttacaaaatgagttattgacaactccggaaatagaagattttttaaattcccatactagatacatgtgggcattgacattcaaagcttccctcatgctatttcctttagtcctgtcctttggggattgcctctgagggtgagagggtagttcaggtttccaggcttgttcagcctttagtctctgtagaggcttccagcaagctgacaagttactgccaaaagtgagacagatggtattttt

SEQ ID NO: 108895 - DNA, 379 bp, Homo sapiens
tctatctgggctccaagctgattgtcacccacattgaggatggatcttcccattcagtctactgactcacatgccattaccctctggaaacactctaaaacatacacccagaattatgctttactaggtctctaggtgttccttaatccacacctgaaacctgaaattaaccgtctcacaggtatactctctttctatttcattaatgcaactctctcttgaattatatctttcttataaggctaggagtggtagctcatataaagtcattattagacaaatgtctgattgctatttagttgtcaatgccttctaaaaatgttgcactcaaacttctcaaaaataaacaaacaaaaaatactttagaagtatttaattc

SEQ ID NO: 108896 - DNA, 202 bp, Homo sapiens
accactcccagcctcattttgcatttagatgtgaaataatttaagggctgtgttgatcatctctctttaactataaaactcaatcagcctccttattttatgccaattgagtttttaactgtaaaacccaatcagcattaaataaaagtgaacacaggtcgaagaatctgtagtagaatctgatttattcttttttgagact

SEQ ID NO: 108897 - DNA, 329 bp, Homo sapiens
tgccccagcggcaggattccagagctgcacgcggccgcccaggcacctccaggcctcctcggaagctgcttaaaccctcgcattcacaaccattttaaaacaatcagtgttctcagatggaaaccatttaacgagacatttattgttttcaccctaaaacgtgaagggtccctccacagaaaccatcaacacagctcatcccacaaagcaatcactgctcgtagggcctctcaggattagctctgttgaaaaaatactaacaaaaacctagacatggaatctggggaccagccctctcacaaggaactcaactcacagagacattttac

SEQ ID NO: 108898 - DNA, 2475 bp, Homo sapiens
  misc_feature (1)..(2): n is a, c, g, or t
  misc_feature (2139)..(2139): n is a, c, g, or t
  misc_feature (2147)..(2148): n is a, c, g, or t
  misc_feature (2153)..(2156): n is a, c, g, or t
  misc_feature (2158)..(2158): n is a, c, g, or t
nntgttctctacagaagatttaaatcaacaaaaagatataaaattgcaaaggttgctcagtcaaaaccatgattatcaaggaagcaaagcttctggttccaaatttggtaatctgctacccatgttaagtttccagtttttatctggttgcccttcagtttagggaccactggcccagaacacacattactggcttagataccggcctgacataggaaagagagtggtagggtgaagagagtcattctctgcaggctcagagatgtgtaggcacaaggactcccgctatgtaatatactgaattgctcaattatccaaagtccacataagcaaaaagctcaaataaacagatttttcaaactgtctgtatatgctaataggcaattatagcaatggccctggaatataggcctgattcagaactcagtaactctgaataaagcacattataaagtgtttcaatttactaaacacagcagcctgatatctaaccatcccaggtaaaagagtcttggctaagggtggtagccagatggcactgcctcagaatcacagaataactgctggtggggataagagctggactccccagtctgggtcctggatcccaaccacaggtgtaaattcaagtccagcaaatgccccctactcccatctctccaaagtctgtacaaggtgtactcagcagccagagcttacgcattagcattaggcaaagggtgttttcccaccacctaggatcggatccatgctgacccaccacctcacagagaacaatgggtttatgttttttggggtttttttgaggctgagtcttgctctgtcgcccaagctagagtgtagtggcatgatctgggctcactgcaacctctgcctcctgggttcaagagattctcctgcctcagcctccctagtagctgggattacaggcacgcgccactatgcctggctaatttttgtacttttagtagagatggggtttcgtcatgttggccaggctggtctcaaactcctgacctcaggtgatctgcccacctcagcctcccaaagtgctgggattataggcgtgagtcaccatgcccggcctgggtttatggtttaaatgagtaataatgtgattcctccttcaaaatttttaccctcaaatagttcccacagtaggtttcctttaacagaagcatgagtccagcttctaaatacagttaaaacaaacaaacaaaaaatacatgtttgtagagaagtaatgcactatgaaatgcatcctcaggagcatacatttatggtaacaatagatttctcctttgaaaaattttaatcaccacatttcaaaattgccacatccaatttcctgattaggaaaaaaaacaaatctttaaaaaaacacacaagcatcagctggcaaagtttttattttcttaagcacattggttttgtagctctagcttccaaaactaaggtaacataaaaatccagagaaatcgtgtaattgaagtaaaaaaaaacagagcacaggaaagaaaacagagaaaattggcagcagactcgtggctgtttcagtggttgatctttgccatgaaatcttcttaataacaaatagagcatttattaataagcatttaacctgtagcacctccccttctccccatgcagatggaggaggctcccacatcggctctaccagggagctcaagaaacagccacacacagctggcaagtggcacagacagccttgaacttgagccttctggctccagagcccaacctctgcaaatccaatttgttgactctactttctaggaaagttgccctcttaaacagagaaaagtccttccatttaacacaaccaatattcaaatggccttcaagaaaatacaatgggctaggcacaatggctcacttctgtattcccagcactttgggagaccgaggcaagtggatctcttgagctcaggagttcgagaccagcccgggtagcacggtgaaaccctgtctctaccaagaatacaaaaaattagccaagtgtggtggtgtgcacctgtggttccagctactagggaggttgaggtgggaggattgcctgagcctgacaggcagaggttgcagtgagctgtgattgtgccactgcactccagcctgggngacagagnnagacnnnntntcaaaaaaaaaaaaaaaattttttttcactgcaaaggccaggcgtgatggctcacacctataatcccagcactttgagaggtcgaggtgggtggatcacctgagttcaggagttcaagaccagcgtaaccaacatggagaaaccccatctcaactaaaaatacaaacaatcagccgggcatggtggcgcatgcctgtaatcccaactacttgggagactgaggcaggagaattgcttgaacctgggaggtggaggttgcagtgtgccgagatcatgtcattgcactccagcctaggcaacgagcaaaactctgtttc

SEQ ID NO: 108899 - DNA, 702 bp, Homo sapiens
tttccccacaactgtgatgctttatcctttgacattaagaatgctgtttgcagaagtaacattcctttgaacactcagctttctgaaatggtgtcccaccgcaaggacctggagaagggtaaacctcaggttctcctcctgccttttgctaagtatatgtcttgatgacaagccttctgctgatgagctgtgtttctggaccgatcatggtagaagtcaattaacgtgtccctcacttggggtttctcaaggctgcactgatgaggaaactgaaacagaaaatccagagtaaattccaccaggccacacagcaaggtctgatagagccaggagagactttatgaaatccagactctcacactaatgctctatcagctagacctccatgtgagtctccccaatgtaggtaggaagtgctttccctaaaatgctcataaagcaaatcagagcaatgctgcattccatgtgatttctaatttgaaatgcaaacaattgccaatttgtttgacttgtatttataattatttccttgtgaattactcatcactaaatgctttataaatattttctctttttttcctcaatgtctatggaatgatcacagcatagaaaatgttggctttcaaggatttattaatatctccttttgaaataacatgtatttgtaagacagaataaaatcactttaaagaaacaaatctt

SEQ ID NO: 108900 - DNA, 674 bp, Homo sapiens
tccttgagacagggtcttcctctgccacccaggctggagtgtgcagcagcatgaccgtggcttactgcagcttcaacctctcaggattaggtaaacctcaggttctcctcctgccttttgctaagtatatgtcttgatgacaagccttctgctgatgagctgtgtttctggaccgatcatggtagaagtcaattaacgtgtccctcacttggggtttctcaaggctgcactgatgaggaaactgaaacagaaaatccagagtaaattccaccaggccacacagcaaggtctgatagagccaggagagactttatgaaatccagactctcacactaatgctctatcagctagacctccatgtgagtctccccaatgtaggtaggaagtgctttccctaaaatgctcataaagcaaatcagagcaatgctgcattccatgtgatttctaatttgaaatgcaaacaattgccaatttgtttgacttgtatttataattatttccttgtgaattactcatcactaaatgctttataaatattttctctttttttcctcaatgtctatggaatgatcacagcatagaaaatgttggctttcaaggatttattaatatctccttttgaaataacatgtatttgtaagacagaataaaatcactttaaagaaacaaatctt

SEQ ID NO: 108901 - DNA, 1150 bp, Homo sapiens
  misc_feature (734)..(734): n is a, c, g, or t
  misc_feature (912)..(912): n is a, c, g, or t
  misc_feature (1029)..(1029): n is a, c, g, or t
tttccccacaactgtgatgctttatcctttgacattaagaatgctgtttgcagaagtaacattcctttgaacactcagctttctgaaatggtgtcccaccgcaaggacctggagaaggacacaaagcaaattcgagcgattttcttatttgagttcaaaatgggctgtaaagcagtggagacaactcgcaacatcaacaatccatttggcccaggaactgctaatgaatgtacagtggagtggtggttcaagaagtctggcaaaggagatgagagccttgaagatgaggagtgtagtggctgaccattggaaattgacaacaaccaattaagagcggtcatcaaagctgatcctcttacaatgacacaagaagttgccaaagaactcaatgttgaccattctttggtcattcagcatttgaagcaaattgggaaggtgaaaaagcttgatgagtgggtgcctcatgagctgagcgaaaatttttttaaaaatcattgttttgaagcgttgtcttctcttattctacgcaacaacagtgaaccatttctctatcagattgtgatgtgcaaggaaaagtggattttatatgacaattggtgatgcccagctcagtggttggacagagaagaaactccaaagcacttcccaaaaccaaacttgcaccaaaaaaaggtcatggtcaccatttggtggtctgctgccggtgtaatcgactacagctttctgaaccccancaaatcattacgtctgaaaagtatgctcagcaaattgatgagatgtactgaaaactgcaatgcctgcagccggcattggtcaacagaaagggcccaactctttacaacaactctcgaccacatgtcgcacaaccaacacttcaaaagttgaatgaattgggctatgaagttttgactnatctgtcattcacctgacctcctgccaactgactaccacatcttcaatcatctcgacagatttttgcagggaaaaagcttctacgatcatcaggatgcagaaaatgctttccaaganttcatcaaatcccaaagcatggatttttatgttacaggaataaacaaacttatttctcattggtaaaaatatgttgattgtaatggttcctattttgattaataaagatgtgtttgagcct

SEQ ID NO: 108902 - DNA, 799 bp, Homo sapiens
tttccccacaactgtgatgctttatcctttgacattaagaatgctgtttgcagaagtaacattcctttgaacactcagctttctgaaatggtgtcccaccgcaaggacctggagaagggtaaacctcaggttctcctcctgccttttgctaagtatatgtcttgatgacaagccttctgctgatgagctgtgtttctggaccgatcatggtagaagtcaattaacgtgtccctcacttggggtttctcaagggtatgttaccacaaagactctcatacacccttttttctgatctccctttcccattctacacttgtgtgctgaatctgtttagcattatagttagtacacttacacgtccactaaaaagtggaaattaatttaattaccaatgaagtaacaagaatttagtttggcaatggatttcttctataatccaaagccaagttacctttccactcatggttctaaagattactcaactgtgtaaatcatctgtgccacatggaataactcaaagtaagttctttcaccccctactcattctaagtacaccaaataaaactctgcctcttttggagagttcatacactgttcagagaaggctgtgaggtatttatgatatctaatccagaaggaactcaagtgatgtttgttttagaaatagaaagcaaagaatgattatgctgcaaatattatcatgaagacatttataaatatattacaaatgcatgtttcccgccaaataattgacaaaacactattacttgccttaaaaataatgcacaattaatgaatg

SEQ ID NO: 108903 - DNA, 750 bp, Homo sapiens
tttccccacaactgtgatgctttatcctttgacattaagaatgctgtttgcagaagtaacattcctttgaacactcagctttctgaaatggtgtcccaccgcaaggacctggagaagggtaaacctcaggttctcctcctgccttttgctaagtatatgtcttgatgacaagccttctgctgatgagctgtgtttctggaccgatcatggtagaagtcaattaacgtgtccctcacttggggtttctcaaggacatgcaaggtcctcatgattgtctcaaaactatatagaattgagaagctgcactgatgaggaaactgaaacagaaaatccagagtaaattccaccaggccacacagcaaggtctgatagagccaggagagactttatgaaatccagactctcacactaatgctctatcagctagacctccatgtgagtctccccaatgtaggtaggaagtgctttccctaaaatgctcataaagcaaatcagagcaatgctgcattccatgtgatttctaatttgaaatgcaaacaattgccaatttgtttgacttgtatttataattatttccttgtgaattactcatcactaaatgctttataaatattttctctttttttcctcaatgtctatggaatgatcacagcatagaaaatgttggctttcaaggatttattaatatctccttttgaaataacatgtatttgtaagacagaataaaatcactttaaagaaacaaatctt

SEQ ID NO: 108904 - DNA, 170 bp, Homo sapiens
tgcagtcctgatacttggaggtctcccccccacccccagcttgagggctggcttcctttcggtggtcttcaaatcaactcacactcggccgttggagaagcctatgtgtctggccaggcaggctccatggatgtggccagtgtctttgtggacggtgggaaccagctttg

SEQ ID NO: 108905 - DNA, 307 bp, Homo sapiens
caaatatcattcagcctggtcatctaggatgaattctccttctatattcatagcagggctgagcccagcaaagaggtaagtaaagcccctcaagcagatcctgaaatcactctcactgggaaagtccacacatgaaacttctgtatgacgcagtgccaggccttgatgactgtagggattttggtagctgtgataaaaagcaaacagataaataaatacaagcataagtaaagttgtgcctttccagtactctttacaggccaagagaaaatggttaaatgagagccccaaatgtacttgggatgtg

SEQ ID NO: 108906 - DNA, 412 bp, Homo sapiens
  misc_feature (134)..(134): n is a, c, g, or t
  misc_feature (136)..(136): n is a, c, g, or t
  misc_feature (139)..(139): n is a, c, g, or t
ggaaaacttataagttgattgatgaaaaataataccatggatttgattatcttgtcatggagagagatgtggtgtggacactatcagctttggttccactgaagttctatcagatttgtgccgggacctagtgngnggngagaggtgttgtggtggccgaggggaagattggtgcgcgatgtgtgagggggggggggtggggggggtgggggggggggtgtggggggggggtgggggggtggggtgggtgtgagtgggtgtgggtggggtgatgtatggggaggtaagcatcgtgaggtgtttattggagctctttgcctagaactgataattggattcatggtattctggagaacaaggaaacaggctgaggaagaataagagacttgcttgaggaagaaaactgaagccc

SEQ ID NO: 108907 - DNA, 452 bp, Homo sapiens
ggtggtattattgagctaaatcctcaactttgtctgggcacagtggctaaaaattagccgggcatggtagcatgcacctgtagtcccagctacttgggaggctgaggcggaaggatcgcttgagcttgagaggcggaagttgcagtgagccaagatggcactactgcactccagcctgggagacagagaaagaccctgtgtcaacataaataaatatataaataaatcatcaagtctcatattaaagactctgtaaatatgacttattgttgacaaatgaaacaaatagaggtgtaagcatgttgtctacatggaggcaagaccagaataatagaaaatggaaacagattcccttaaagaggggaatcgtgtctttctcattggctcaatgtagtctccgtagagtctagaatgcttcagcacctggcacactgcttaacaaatggtgaatg

SEQ ID NO: 108908 - DNA, 475 bp, Homo sapiens
tcttcttgtgcttggagttctacagtcctgatcatctcaacttaaaggagatcccgccggtgcagtggctcacacctgtaatcccagcactttggcaggctgagggggtggatccatgaggcaggaatgttcaagagtgcctcatttattacaaatgcctaggacgggctgggcctagtggctcaatcctatagtcccagcactttgggaggccaaggcgagaggatcgcgtgagctcaagagtttgagaccaacctgggcaacatagtgagaccttgtctctactaaaatacatccatgcctatggagagcagagcttaccactgtaattatacactagatttctgtcatttccttctaacttaatgataggtaatcttcctttaaacatgtgctgaagttcctacagtcctgaccatctcaacttaaaggagatcccgccgggtgcagtggctcacacctgtaatcccagcac

SEQ ID NO: 108909 - DNA, 196 bp, Homo sapiens
gaaagtgggggagaagaggaccctataacccagagacaagaggccatcaggcaccctgaagcctaggggccctcatctccactctaacaaaacacacatttgcagtgacccccatccccacccttgacttctcttcctcacccagagcacgggagggtgccactacccactcttagagcagacctggcatgcccac

SEQ ID NO: 108910 - DNA, 426 bp, Homo sapiens
tgtgatagaatcctccaagcaccgcaccttactgcctcccttgtgtatgtgatagaatcctccaagcaccgcgccttaatgcctcccttgtgtatgtgacagaatcctccaagcaccgcgccttaatgcctcccttgtatatgtgatagaatcctccaagcaccgcgccttactgcctctcttgtgtatgtgacagaatcctccaagcaccgcaccttactgcctcccttgtatatgtgatagaatcctccaagcaccgcaccttactgcctcccttgtatatgtgatagaatccaatgcagctcattctttctactgctgcaactcacaactgatttcactaccatcaagatatcacaatcggcagctgccagttgtgagatacctaggtgatccttaggtctcttccagctctagggttctctg

SEQ ID NO: 108911 - DNA, 161 bp, Homo sapiens
cccaggctagagtgcagtagcatgataatagttcactgtaacctcaaactcctggatttaagggatcctcccacctctgcctcccgggtagctgggactacaggcacatgccacccagataatttttttaaattactttttgtagactatggatttcattg

SEQ ID NO: 108912 - DNA, 349 bp, Homo sapiens
tgagaggcaggctggtttgggacttaaattcacgaatgactgtaagaagcctcagatcccattgattctccaagaattgaggtcgaggctggataatctttgaggggctggtaccctttgtcaaagaccacaaagcacggccatgcccatggagagtagtaaggtattaattggcaaagttaggtgctaatgccacttttctacccaagaagagaataatgctaaatgacctgagaaggtcacttaggtcactgtctctatcattgagatgtggttggaatgccttccacagtctgcaccctgagcctcgtgatcttctcaatcaaacagagcaggcagttctgtttca

SEQ ID NO: 108913 - DNA, 687 bp, Homo sapiens
agcaattctcctgcctctccttaaaacatctcggtgtttgtccgagatgacggtgctcctcctcaatcaaccaccacacctggccaatattttgtagagatggggttttcccatgttgcccaggctggtctcaaactcctgggctcaagtgatttgcccgcctcagcctcccaaaatgctggattacaggtgtgagctactgcacctggcacagattttttaaaagatcaaattaggtactaggtataaagcatttaaactgtgtcaggcacattttaagtgctcagtagatagtgctggtaggctggctatagtagctcacgcctctaatctcagcattttgagaggctgaggcaggaggatcacttgagctcaaaagttcaagcccagcctgggcaacatagcaagaccttgtctctactaaaaataaaaaataaattagctgggcatcaggcatcgtgcacaatcctgtactcccggctacttgtgaggccgaggtaggaggattgtttgagcctgggaggtcaaggctgcagtaagctatgattgcaccactgcatcctggttgacagagcaagattctgtaagtaagtaaataaaataaataaataaataaataaatatagcaagctggtttggagtgaggaatattaatagttgtgttaaggaaagaaaagaaaaaaaaaa

SEQ ID NO: 108914 - DNA, 255 bp, Homo sapiens
ggatgtggatgttattggggtgatgaaaatgttctaaagcattttatgatgatggttgcataactgggtatgtttactaaaaaccattgagctatattcttgaaatgggtgaattacatgatatttaaaatgtgcctcaataaagttactttctgaaggatttttttaaatgaccaggcagattttttaaactatcacattatgaaggcttctgtttcttctgcttccttttcaaggccccatcctgaattgcta

SEQ ID NO: 108915 - DNA, 124 bp, Homo sapiens
tggcagtgcagcccctggctgaggtgtagcagtcatcaataccagccatcatgagcagcttcttgggcacgggctgagacgatgccagtgcccttgggcgcagggatgaggtgcaccagcacag

SEQ ID NO: 108916 - DNA, 419 bp, Homo sapiens
  misc_feature (8)..(8): n is a, c, g, or t
  misc_feature (14)..(15): n is a, c, g, or t
agaggatncccatnnggcgaggcagtctcctctgagagccaacttcaaggctttctctcagggaagctgctgtggttttaatgcctagtggtgttttacggttgcagaagtcatcctcaaggtcgctttttggccgtctacatgtgaggatgcaccagacagatgaagctccagctacccaccgtgcttcctgattttttgttgaaagtcatcaatttctctgaggctcagctctattcctcccaagtcctgggcccttggctggctttttaatttgtgtggcgttattacgttatgtacttgtcagcagagatttcattaagttcccataatatggccacgctgcacattatccaaactaaaacaaccatctctgggcttgttcagagactgccacgccaaatgaattcttcatgatt

SEQ ID NO: 108917 - DNA, 381 bp, Homo sapiens
tattaaaggatttggctgaaataagagttccctatgttgtattaaggacagtaactcatttcagtgttctacaatgtaattattcatctgttgttgaacatttgagctgatatatgtaatataagaaaaaatagggaatatttttgtataaatatttatacacctctctatttctttaaattctgtaatcgactaataggtcatgaacatctttaagatttttgacacaatgtcatattactttcagaaaaattttactattttacactcccagccattagtatgtgagagttcctctttcacttttcccaggtttggaaacatttataatctcttatctttgccagtctgaaagatgaaagtggagcttgttttattttg

SEQ ID NO: 108918 - DNA, 618 bp, Homo sapiens
agtggtggctcaagcctgtaatcctagcaatttgggaggccaagacaggtgaatcacctgaggacaggagttcgagactatcctggccaacatggtgaaacactgtctctactaaaaatacaaaaatttgccaggtgtggtggcaggcgcctgtaatcccagctacttgggaagctgaggcaggataatcgcttgaacccaggaagcagaggttacagtgagccaagatcgtgcccttgcactccagcctgggtgacaagagcgaaactccatctcaaaaataaaaaaattgaattaaattgaatcaatggatagtatttacaagcctcatggtaacctcaaataaaaaaacatacactggatacacaaaaaatagaaaccaagaaaatcagtgataccaccagagaaaatcaccttcactaaaagcaagaaagagggagggaagaaggaaggaaggaaaaagaagaccagaaaacaaataacaaaatggcaggattaagtccttacttaccaatacaaacattgaatataaatgaactaaactcttcagccatgagttaaaagacactgagtggctgaatggattaaaaaaataagccccacctatctggtgcctat

SEQ ID NO: 108919 - DNA, 281 bp, Homo sapiens
catggtcgatgtttacagaaagtatctttttattacaaaaggcagagataaattacatccaaatattttcagaccatcaaaagtctttaagtaactcacattcctccacagagattatcctggtagccaaattaacagaatcagccaagcacataaggaacttagcacataaagatactcaataaaatccaattataaaggagcaaatttctacgaacttgaaactaccacccaccctgctgccagaatgtaatgatatgttctctgcatgccaaacatat

SEQ ID NO: 108920 - DNA, 399 bp, Homo sapiens
ttttttgagatggagtctcacgctgctgcccaggctggagtgcaatagcacaatctcagatcactgcaacctctgcttctcaggttcaagcgattctcgtgcctcagcctcccaagtaaatgggattataggtgcatgccaccacacccagctaatttttttatttttagtagagatggggttttaccgtgttggccaggctggtctcgaactcctgacctcagatgatctgccagcctcagcctcccaaagtgctgggatttacaggcgcgaaccaccatgcccagcccctgaaaaacattttgatgaaaagaagactgattctgaaaacattaattcaggtctagttacatagctgaaatcttccagaaagctggaagatttatatacatatgtgtg

SEQ ID NO: 108921 - DNA, 518 bp, Homo sapiens
cctgaccctgttgactctacactccttcttaactcttccctggtcctttcatagtatacattcctcatctacccagatccctctggtaatgcctgctagctccttttcctcttgcattctacataaatatagatatgccctaaatatcatagcttttccagtagtaaggatcatatctagcacacacattttcttcttcccacctctcttctgtctccatatactgccagtgggagttcaacctattagaaatgccctctgacaaccaaaaacatccttctctttcatcacccgtaaataagcacctaccatgtgagattcagcacaggaggggaatctgggatcagactgcctaatttcaaatcccagctcagcttctttagcacatgccattgtgacctggcaagattcttcccaagtcttcattttttcttctaaccacctacgattgttgtgaagactaatgagaaattactcatacagagttactcagtgaagtggctggcttgcagcattaa

SEQ ID NO: 108922 - DNA, 312 bp, Homo sapiens
cagatggaaggcctccaggctccatgatttatagactgtcagcatcctatagcctttcttgtgcctcccattacatccttttctcaagttcttcatttacaatgaccaaaaatgaccagtaatagctttagatgtgacctcttctaagagtccttacattttaaagcaatcaaaactttagttaaaccagaagaatgaaactccagtgtggtcagatatctgagtcttagtatcagctagctctcttgcttgcttgctgtgagatctttggcaagtttctttaactttctggagctggtttcttcattcata

SEQ ID NO: 108923 - DNA, 355 bp, Homo sapiens
aaactcagtgactgaaagtgtgaaccaaggatagtatagtcatccatgatctccttcaagtatgaacgctaaaagaaacagttttcaatataggaaattctgtacccatgaacccttcttgaggaatactagaggaagagtttcatctaaccatgagatgagtaacaaagtgtcagtacaaggactgactatattttaataaatataaatgtaggcagaagataaaaggggtggaagacccatatacaaatactgtatgttaagtagaagtaatacaactttagaaaatgggagtggaacagagagtgaaagagtaagatagaataagctcactgatggttgtatagccaatagt

SEQ ID NO: 108924 - DNA, 460 bp, Homo sapiens
tctcaatcatataataagcattagctgacatttttataatcattaagaaaataagcagactctctgttgaaatttttccaggtgaagtttgaattagagtcaaaattgtagaaagcttgctatgaagccccttcactttaaacttatttggcattctaataacaactccattttataatcacagattctaacacaatgccaattctgcttttattttttatttaaaaaatgaggtaatacatgtattatgggaccagaatgaaaaaaatactttcttctgagtacctttccacgtggctcttctggctctgagaaatctttttctctactcagtgaactttgatttcttcttaccgtaaataatgtcttctacactttattcattataccaaggatcagcaaatgatggacatgacccaccacttgtctttgtaaataaagttttattggaacacaaaaa

SEQ ID NO: 108925 - DNA, 360 bp, Homo sapiens
  misc_feature (346)..(346): n is a, c, g, or t
gaaatatatttctattcaaaggattaagaagcagaatgactttatatttcttcgagctaaaaaaaagctgagcagtgtcctcaaaattctcaagaaaaatgaatttcccaacatagaattccgagcccaataaaattgtcactgattgtgatgatagaccgaagacatttctgatagtttagctctcaaaaattttacctactttacacgccttctctgaaatgtaataaaggatgtgcatcaccaaataagagggaggagggggtcaagaaagtgggatccggatgagctgaatcaagagtgaggtgacaagaaaactcaggttaacaggcaggagacaccggtntttttttcacatgc

SEQ ID NO: 108926 - DNA, 1453 bp, Homo sapiens
cccgcgatactgtcagagatggagaaaggtatgacaggaagagcagatcaagaagacgggaacagcacgaggcactgggagctgcaaacgcccacgatactgtcagagatggagaaaggtatggccatggctgacacaaaatgttactcaacatttatcacaggcctaaatggagaacatgacgctataaaacccttagataaaaacacaggaaaatttgtatggcctggggttgggcgaaaagttcttagacatgacaccaaaagcatgattcataaaagattgacaaattaaacttaatcataaatttaaaattataattctataaagcaatataaaaatctaaagagaatgaaacacaaactatggtctagaaaaaagtatttgtgaatcacacgtctcacaacgtactggcacgcaggatatgtgaagaaccaccaaaacttaaccataagaaagtaaaaaccccagtattaaagagagggcagatatttgaatggagaatcaaagaaggtataaggagggcatattgcccgagaaagaggctcaacatcatagagatgctggagaaatgccagtcaacagtacctctgcaaatctattaaaatggctaaaaacagacaaaaaccacaggccgacccaggttctagtgatgatgccgaggaactgggaccctcataagctgcagtgggaatgggacgggtcccgccatgctggaaagtggtccgggagtttcttatgaagttaagcacatctttaccctgtcatccagcaaccccgctcctgaaacgtcccccaagagaaaacttaaacatgcatgcacaaacctgcacacaagtgtttaggcctcattcctcattgccaataactggaagaaaacaaaatgtccatcggcaggaggaggcgggaaccaacgcggatgcttccacacagggggcaccaaccagcagtggaaggatgcacccaaatgccccaggtctcccaggccatatgcccggtgaaggaagctagtttcggtgcgcacaggccgagggatgccgccgcatgacatcttggagaagacagtgctaccgtgttggggagcagggcagtggtttcgaggggctatgggtggaggggcgaatggaggagctctctggggcagtggtgtgagcacctgcacctcactgtgggctgctgcggctgagaggctgtacagcaaacactggcttcagtacacgcagactgaaggtggaaggcttccgcaagtcaaagacagagggtgtcacctccatgaaacaaaaacattaaaaaaaaactcttaaaattaagaaaaaaaccacaaaaagtatttcataagcccgttggactttgagttgacatcatctacctgggagcatggaactgaaaccacaggcttggcaatcccagagggagagagtggagggtttagacctccattgaagggctcagt

SEQ ID NO: 108927 - DNA, 386 bp, Homo sapiens
gataagtattcctgtatctaaacatagctaaacagaaaaggaacagtatttgatacagtccggattatgatattataatcttacggaaccaccatcattaatgaggtccaccattgactgaaacatcattatgcaaagcatgactgtatagtcaatatgttataaggacatcctttggtacttcaataactaagccctcgtgaatgagacctgctgattctaccatgatactgatcatagagaaaatgttaactttctatatgggtgcttgaagaagatactcagacaactaacaaaacgagatgagaaataagataaaaatccgggccaggcatcgtggctcacacctgtagtcccaacactttgggaggctgaggcaggtggat

SEQ ID NO: 108928 - DNA, 339 bp, Homo sapiens
gatcctaagaagcataatcagaaatgacaaaggtgacagaactcatactacaaaaatacaaaagagcctcagagactactatgaacatctttatgtgcacaaactagaaaaaccagaggaaatggataaattcttggaaacacacaacctcccaagattgaacaaggaagaaactgaaatcctgaacagatcataacaatttacaaaattgaatcagttataaaaacaaatctacaaaccaaaaaaagaccaggatcagatgcattcacagccaaattataccagacaaacaaagaagagctggtatcaatcttactgaaactactccaaaaaatcaag

SEQ ID NO: 108929 - DNA, 265 bp, Homo sapiens
agataagggaaaagctaaagatacatgggagagcatgcgccatgatttatacaagagccaagaccgctagactgcattgggttcatactgatgaacagtggaaaataagagcttcctaggtaaagatggcagaaagacccgatgagcagagcaaaggatgcacctttgacttgatgagtggtcattttaggcttttgcatgtggaggaatgagagaaaatgtaagctctaagatagtggcgcagggcagagtatatggggagaga

SEQ ID NO: 108930 - DNA, 812 bp, Homo sapiens
actccatcttcaaagaaaaagtcgctaataaatcacatttggtaggttagtgaatgttaaacacattagtgagcaaaagaaaataggaatgaacaagaattggtcatctacctaactgaacacaaatgaactctggcagttcagtaataggaggtaaagaaccacgctaattgcagaacagcagcccccctaccttcccaggagcagtgtgactgggaagcagccccgtgtgtatgctggtgcaggttctaagcaaagtgagctgcccatcagttccgatgagtttgctgatgctagacatatgacatctgttctcttgctgcctgccccagttatctcccaaagttctttactgagaatgaaaagcatctttctctgtgtggtgacttcagtaggccaacaaatatttgagtttaaagcacaagactagtcataggcagagcagcgctaccatttacaatttgcttacttgatgctaaaccgtgggtttggcattttacagtcatatcatctagcccagcaagtcatggaagcatagttgttaaaatcatctgacactttgggaggctgaggcgggcggatcacgaggtcaggagattgagaccatcctggctaacatggtgaaaccctgtctccactaaaaatacaaaaaaattagccgggcgtggtggcaggagcctgtagtcccagctactcaggaagctgaggcaggagaatggtgtgaacctggaaggtggagcttacagtgagctgagatcacgccactgcactccagcctgggcaagtgagactccatctcaaaaaaaaaaaaa

SEQ ID NO: 108931 - DNA, 318 bp, Homo sapiens
agaaaaggaagaagaagatgcttcgggcagcgtgtggctcacagagcctcggctgctcactcccgggccctcggcaggacgggatctggccggtgctctaggagcttttgaacttttatctttctttatcagtgattttcagcattgtattttccaggtgccttggtgggcttttctttgtgttctacttagcatttgttgtttcttggatctgtctgtagttttcatcatatttggaagatttttagccattactcaaatgtcattttccaccactgcctcttcctcctcctgctggactgtggcactctgaggaca

SEQ ID NO: 108932 - DNA, 281 bp, Homo sapiens
tagtacctagctcagactgttggtgtaaaaattaaatgagctaattaaaattaaaaagtaaagtgttttgcacagagacactcctagtaagccctgaagaaatgagagctatgcttttgattattaatattcttataatccaaaggatgatgcaggattttttaaatctttccacatgtatgtttttggaccagtccaaaaaagaattggaaacacacttatgccgcataaagacagagttatgaggaactataaaaacaaaataaaacctttggagaatc

SEQ ID NO: 108933 - DNA, 191 bp, Homo sapiens
cctactgttttaatctaaggtcttctcatttcatttacttcatataaattcatttaaacatcatgtaatatcttataaacatcctaaaatcaaagatttaactttcccgactgccttcttaaagtattcaagacatagaatgctctgatttttttctttatttgatactatctattaaaatttgaattgtg

SEQ ID NO: 108934 - DNA, 2343 bp, Homo sapiens
gggacgcgctaatgttgccgggaagcagctccgggttgcagggcaggaacgtgcccttcccccgcggcaaacttgccgtcgctgcgacggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttgggaatcagaggcaatgagcccgtatatacttcaactcaagaagactgcattaattcttgctgttcaacaaaaaacatatcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctctgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactcagtagtgttctcataagtagcatg

SEQ ID NO: 108935 - DNA, 1981 bp, Homo sapiens
gggacgcgctaatgttgccgggaagcagctccgggttgcagggcaggaacgtgcccttcccccgcggcaaacttgccgtcgctgcgacggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatacttcaactcaagaagactgcattaattcttgctgttcaacaaaaaacatatcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtatttgacgacggcgatcacttggacccaggagctggtgttgcgtgccgagatacgcatgtacccgcagagtggctccctctgaaaaagcgggcgccgggtcagccgggccccttggccggcgcgtcccgggcggtcgcgctgtctggaccctcttatcaatatggggcctccctggggggaaggcacgggggggccctccgggcccaacctgggggtcttcgtctctaga

SEQ ID NO: 108936 - DNA, 1529 bp, Homo sapiens
tagcggcaccattttgaaggcgtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctctgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactcagtagtgttctcataagtagcatg

SEQ ID NO: 108937 - DNA, 638 bp, Homo sapiens
  misc_feature (135)..(135): n is a, c, g, or t
  misc_feature (200)..(200): n is a, c, g, or t
  misc_feature (203)..(203): n is a, c, g, or t
tttttttttttggtttgggttggtttgggtttttgggttgggttttgttttgttttttaaaacaaagtatccaatgttttataggggccaaaggttaacttgggcactattcctgtcagttaaaggccactgaanattttctaagttagcaaggctcacttgctgctttcttgcctcccttgcctcccatccctctcccntcntacctttctatttacctatttctctccctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactcagtagtgttctcataagtagcatg

SEQ ID NO: 108938 - DNA, 1073 bp, Homo sapiens
gggacgcgctaatgttgccgggaagcagctccgggttgcagggcaggaacgtgcccttcccccgcggcaaacttgccgtcgctgcgacggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatacttcaactcaagaagactgcattaattcttgctgttcaacaaaaaacatatcaggtaaatagtggtttcttggcaatcctttgttccatgtgttttgtggcttcaggagctgggggatgtggctgaataacttataccagtgattctcgacagggtatgaatataagtgacaaaatcactggagaattttctacaagtgtgccctcccctctcctaagctgagtcaaagttattgatgaatgtatgtatatatccctcaggtgactgggtagacaagaggttgagaatcactggtgttatatcccaactggtatctagaatattgaaaacaaaaatcctattgaaatggttagctgccatcagcatggagtattggaatacagtgtgatattacaaagaaaatgtaaacagagaaaaggggttgagacaaaaaatagaattcttatctcttgggaaaatcagcatttgatctttaagttggaagcataaaacctccacttcgtctccttccttggagctggtggcataggataagtcaaaa

SEQ ID NO: 108939 - DNA, 2445 bp, Homo sapiens
gggacgcgctaatgttgccgggaagcagctccgggttgcagggcaggaacgtgcccttcccccgcggcaaacttgccgtcgctgcgacggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccagagagaaatctcatcatctgtgcagccttcttaaagcaaactaagaccagagggaggattatccttgacctttgaagaccaaaactaaactgaaatttaaaatgttcttcgggggagaagggagcttgacttacactttggtaataatttgcttcctgacactaaggctgtctgctagtcagaattgcctcaaaaagagtctagaagatgttgtcattgacatccagtcatctctttctaagggaatcagaggcaatgagcccgtatatacttcaactcaagaagactgcattaattcttgctgttcaacaaaaaacatatcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctctgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactcagtagtgttctcataagtagcatg

SEQ ID NO: 108940 - DNA, 2005 bp, Homo sapiens
gaaatgattcagcggtcagcaagcaagtgaacaaaatgaacaaaggtgtttgtgttggactccataataagtgaagtttttcctacttgccctactctttagaaaatcgcatttcaaaatcatgcttatgaaacctttcattgcaggggacaaagcatgtaacttgatgatcttcgacactcgaaaaacagctagacaacccaactgctacctatttttctgtcccaacgaggaagcctgtccattgaaaccagcaaaaggacttatgagttacaggataattacagattttccatctttgaccagaaatttgccaagccaagagttaccccaggaagattctctcttacatggccaattttcacaagcagtcactcccctagcccatcatcacacagattattcaaagcccaccgatatctcatggagagacacactttctcagaagtttggatcctcagatcacttggagaaactatttaagatggatgaagcaagtgcccagctccttgcttataaggaaaaaggccattctcagagttcacaattttcctctgatcaagaaatagctcatctgctgcctgaaaatgtgagtgcgctcccagctacggtggcagttgcttctccacataccacctcggctactccaaagcccgccacccttctacccaccaatgcttcagtgacaccttctgggacttcccagccacagctggccaccacagctccacctgtaaccactgtcacttctcagcctcccacgaccctcatttctacagtttttacacgggctgcggctacactccaagcaatggctacaacagcagttctgactaccacctttcaggcacctacggactcgaaaggcagcttagaaaccataccgtttacagaaatctccaacctaactttgaacacagggaatgtgtataaccctactgcactttctatgtcaaatgtggagtcttccactatgaataaaactgcttcctgggaaggtagggaggccagtccaggcagttcctcccagggcagtgttccagaaaatcagtacggccttccatttgaaaaatggcttcttatcgggtccctgctctttggtgtcctgttcctggtgataggcctcgtcctcctgggtagaatcctctcggaatcactccgcaggaaacgttactcaagactggattatttgatcaatgggatctatgtggacatctaaggatggaactcggtgtctcttaattcatttagtaaccagaagcccaaatgcaatgagtttctgctgacttgctagtcttagcaggaggttgtattttgaagacaggaaaatgcccccttctgctttccttttttttttttggagacagagtcttgctctgttgcccaggctggagtgcagtagcacgatctcggctctcaccgcaacctccgtctcctgggttcaagcgattctcctgcctcagcctcctaagtatctgggattacaggcatgtgccaccacacctgggtgatttttgtatttttagtagagacggggtttcaccatgttggtcaggctggtctcaaactcctgacctagtgatccaccctcctcggcctcccaaagtgctgggattacaggcatgagccaccacagctggcccccttctgttttatgtttggtttttgagaaggaatgaagtgggaaccaaattaggtaattttgggtaatctgtctctaaaatattagctaaaaacaaagctctatgtaaagtaataaagtataattgccatataaatttcaaaattcaactggcttttatgcaaagaaacaggttaggacatctaggttccaattcattcacattcttggttccagataaaatcaactgtttatatcaatttctaatggatttgcttttctttttatatggattcctttaaaacttattccagatgtagttccttccaattaaatatttgaataaatcttttgttactcagtagtgttctcataagtagcatg

SEQ ID NO: 108941 - DNA, 819 bp, Homo sapiens
gcgacggaagcaggaacttgctaaccacaaaacccgccaggccggtgcgggagctgcggagcatccgctgcggtcctcgccgagacccccgcgcggattcgccggtccttcccgcgggcgcgacagagctgtcctcgcacctggatggcagcaggggcgccggggtcctctcgacgccaggtaaaggggtctccccaatacccacccccgaccggccgcaggcgacgtcgctacctgcggagagagtcggtcccctcctttccaggggccgaggctccttcacccacacccgagcatccaaaggaccagctggggccaataagggctgaccaggatccttgagtcgctgcagtattccaaaggggacctctaggcgggctcaaggcacctgccataaatggctctggctctgcgttgacatcagaaggagaggcagaagaatagctcagtaggcaacatgcatttcctcaaaggaagagaaaatgttccctgttttcttgtcgttgactctgtattcattattgaaactgctaattgtctaattctctgtagagtgtgtgtgtgtatacagttataagcatcttggtaaattatagtgtgctgtaagacgatttccaatatttgaactaattacgtgcgagtaagttttagcgactcttgtatgcagacgttaaaactcaggggcatcctctctcacccgcctgtatccttttaccccgtctttcaacaagattcaactcgacttcaggcccttaaagcctaaataataatggattagaaaacgtcgctaacctaatattgctgagcctctttaatgat

SEQ ID NO: 108942 - DNA, 417 bp, Homo sapiens
tgcaaattagtggattttgtgtagaatttggggcaaggatggtttttgtttggtccacatagtatttttaacccatttgtgccagaggttgcaatttttttgtgtgaaaaatcagaccttggcgatgaccttgagcagtaggatataaataactcccacaagcttagcgttccaataatggaacactatgcataaatgagttgaaaatcaagaaatttcacaaagatccaaatttctgacatctcttaaatcttagaaggtctggcagcaatttggatctgcattccatcaaggaaaaacattactggaacccaaatgtcccaaacagcgcatttgtaccatgtccacactcataatcttaatcccaattcattttactcatttatgtcaccacctgattccgtgagcaagagttta

SEQ ID NO: 108943 - DNA, 369 bp, Homo sapiens
tgactcacaaccctaagatatctcctcattccaaacttaacaccacatcccattacccaataccacatcccattacccaatttgccttgtagaactaggaaagtgtttcagttctttgctaaaggccagtgttagcctagacagctttgctccaggcagattaggaaagaaagaatcctcagttttatgactcagccaggagtttttcccacctcttcacttaaaaatacctcagtaacacattacaacctgccatatgaggctgaagatcgcagatctacactcaaataagggtttttctaggtgacagtataacatttcataaagcagcagcataattatgtgacagcaaaatttaaaatatcatgt

SEQ ID NO: 108944 - DNA, 320 bp, Homo sapiens
ttggaagacacccgacgaggattccctgaaaaaattcttaatgagtccctaaggcaaagatttccaagccaagcgcttcaccacataccctcagcggcccagtgcctgagagcctcccctgccaggaagcctagcccagaaacgcctcccgaaacgggtagtggccctggggaagaagcttccctggaaggcacaagcagtaaacgggcagcctcttacctcttaccttcatcagatactggcgggaggcaccctcctggcagatttcttcatccccctctccttctgtgggtgtggagtcactgggagaacaaagggat

SEQ ID NO: 108945 - DNA, 303 bp, Homo sapiens
gctacttaagtcagttactatagttttccaagaaaaactaattatatttgggtctttaaatttattgatatacagtcatttattctattttcttaaatttttaaaacttcttgtgcatatgggttgttaacttctttttcacttattttattgcttacttctgtttttttttctcctttgatttgacctgctcaagggatttgctaattttgttcatctcctcaaagaccaagttcttagatttatttcatccattgtcttttaccatttcattatatttctgcttttgtctttgttaatgct

SEQ ID NO: 108946 - DNA, 665 bp, Homo sapiens
tgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctg

SEQ ID NO: 108947 - DNA, 529 bp, Homo sapiens
caaagcgagggtccgcattagggaagtctgggaggccaggcatgggtggcagctgtgtacagtgagaacattcctgcactcagaattcgtggcttcaaaacacagcttccctattgtcttggttttctagggctgctgtaacaaagtcctgcaaccaggtggcttaaaccaccaggaatttacgtctcgcagttctagaagctgtccttctaaagctctggggagagtctgtcccatgccttgctcctgccttctgggggctcctagcaatccttggtgtcccatggcttgtggatgcatcactctgatccctgtctctatgttcacggggtcttctccccatgtgtgtcctgggttcgacttcagatcttcttataaggataccagtcactgcattagcaccctcctcccaacagcatgttacctaattatatctgcaaagaccctatttacaaataaggtcacattctgaggttccaggtgaacacgaatttgggagagaacaccattcaacccagtacacccaaca

SEQ ID NO: 108948 - DNA, 616 bp, Homo sapiens
ggaagctgagaaaagtgacatctgcctctgaaatagttctgggaacgtcactggagggtgactgccaggttcactcatgccatcagccccgcctttgtgtcctcagtaatttttactctgagcataatcacagccctcgttgagaggagccactgtccctgttggtcttctttctagaagtatctcttatatactgatatacagcagtgcatttacattgttaactgtaaaaatgacaccaacacatttagaaaggccaccagataaaataaagaaaaatgtatccctcaacgctgacatacttactggcttgcttttggaacgttcttctttctgtcttcaggtgctagaactttaggagagtaagtgggctctgttgagggactctgaagactggtcacccccccgcccacacacacacacacatcccccagcacttgagctgcgcttccacataaccacttcctttatgctgggactgtggtttctttgtgtgtttttatgtcttttccatgtctgggtctgggtttgcctcccctgagagaccgtaaacttctaaagaacaagaactgtgttgtctccttttataggagtgtatgtttcattaaaaaaaaaa

SEQ ID NO: 108949 - DNA, 189 bp, Homo sapiens
aaagagcaaatcctgcgtctggcagatggtctgtctttggatggaaattctgcctcctcattcacaggaaatggaagccgacatcacattcaatactggattgttaggtaatggtgtggggtcagaggccaggatctacacacgaaaatttcagatagatggctggttgtcccttcctttctggaagaa

SEQ ID NO: 108950 - DNA, 220 bp, Homo sapiens
ttttgttattttttgtagagacgggggtctcactaagttgctggtcttgaactcctgagctcaagcagtcctcccacctcggcctcccaaagtgctgggattacaggtgtgagccaccgtccctggccaattctcttattttcatatattcatgtcatttagatttttgggcatattgaatatttctacaatagctgtttttttaatctataatttctgg

SEQ ID NO: 108951 - DNA, 794 bp, Homo sapiens
gtagctacgatagtgatgatcaccattgccgtgagtattccttcaacaagggctgacacagagaacaattatacttattgggcatatttatcaatcttggctggcaataatgcctggatgtaatcactctatgacacagttacacatgctttctgatctcagtatttaccataataaatctgttcctataattgaggcatacagccctcaaaaacctatttgtaaacaaaattgaacctggccagaaaatgaacgtacttgtttaggaagattgcattgcagaacaggcagaggtgctgcacaacgattcctatggaatcattattaattggtcccctaaggggatatttagcttgaattgcacctctgagtctgcatgccatggccacactatgttcagatggtctgaacaaaacggtcagatggtagaaatgataaaaagtatgacaagagttcctattatctggaaccatggcagtatagtggcacctcaacctcaaatgatatggcttgttgtaggagctaacataagattttgtggaaactattaatagcttttaataagatcaaaatttgggaaagaatagaaaagcatctagaaggacactctacaaacttgtttttggatattgcaaaattaaaaaaacaaatatttaaagcatcccaggcacacctgaccttaatgccaagaactggagtgcttgaaggagctgcagacagattagcagctagtaacccattaaaatggataaaaacacttggaggctctgtgatttcaatgattattatgcttt

SEQ ID NO: 108952 - DNA, 362 bp, Homo sapiens
catctttctgccctcactgcccagaaggggagctgttgttagctttggcatctttttcacctgtccttccttcctaggccttctcccttgacaagattgagagtatatcttagagttttctcatctcctgccaccttttgatttcttttcttaacagtgggccataagcacctccccaagttacacaaattagttgtcagcacagagcagctgccgagagagttcatcagacagacccccacattccttctggctgtcctcagaggccggatttcttcctcttttgaggatgaagagctttctctgccgaggctgggggaggaggtcagtgaggcagccagtgaatgccgtttttggtcaaa

SEQ ID NO: 108953 - DNA, 355 bp, Homo sapiens
gctgctttccctaacaggctgtatgtagccaaagagaggcctaactgcttatgtgcttgcttccaatgacaaagtgcgtgtgtaagaagcacagatatacttgactgtttataaactactgcaattaataatttatgacaacgactgcaagtcatacaacatctgagggtacctataatacactaagcaagaagctttcactactagaggatggtacggtttgaactctcctggagccctggttctgggcattcagtaggccagcagttcccaaacatgttctacagaacatgagctccatgagaaacagtcttgtgaggctgaggcacagtggctcacaactgtgatcttggca

SEQ ID NO: 108954 - DNA, 429 bp, Homo sapiens
cttcttgtttttctctctttaaactccccaacaggcagtctgtttccattgcctccaccatctatcctatcctttctctggagatcttgttcctgttgtctcagttttattttcagcttcttcattttgctaataaaaacatctaaaatgttcattgtagtaaattaggggcttggcatggtggctcatgcctgtaatcttagcactttgggaggctgaggcaggagaatcacttgaggccacagtaagttcaatctgaagtcgaaaccaaccaatttgtattctgaggcagccaaaatactggttatgggctgggaggagccacatgttggcttatctgagtccactgccaaggaacagatccagagcaatgcatttcaattgctttgaaaaatggctaagttccattacataccaccactaaagaaa

SEQ ID NO: 108955 - DNA, 384 bp, Homo sapiens
ctattcctacacagattcttaaaaagctatactcccgtcttagagttaaatttgaatattttgaaaaatgcacattaaacgtggaaagagatggctctcctctctataaggggctcccaaggcagcctcaaagctcaccaaaagttccaaaacaacatccacaacaaaacaaactctctttcatctctggcagcaacaaaagcaataactttcaccaaacctacccaagccaagaattaatataacacagaacaacacatccacattcagaccattacggctacatcagctcaccacaatatttgtttaaaaaacacataatttgtggtagagagaaagaacctttcatacaaaaagaagttctttcaaatgcaaattaaccaa

SEQ ID NO: 108956 - DNA, 534 bp, Homo sapiens
ttatgtgtacaccaagtcatacaaaaatatgcacccccattaaaataatcaagtgtactcaaacaataattttcccatagcacactgacaaaaatgagagagactgaacctacccagtgctggtacagcacaaatgaaaaatatgcatcctcttacactggaattaggaagatcagttggaacgaggcttctggagcaatttgacagtcaacctaatgatgttttaagtgcacgggctcactgacccagcttccacttcctggaatttgtctagtagtgatacttagaagtttacaaaatatatgtataataattgtttgatgccaatttggaattggtataaacactgctacaaccacataaatatccattcgcaaggtatcaaaagagcaagttatatttgcacacatactgataccaaaagatgcttataacacattaaaatggacagaatgtaaaacacagggccctgcctatagaattatactctatgaaaatgctcacacacatcacactatgtttagacacagaaaa

SEQ ID NO: 108957 - DNA, 720 bp, Homo sapiens
ggtggggacttactcttcatcagtctctcaaatttatttgtctctgacattatttctggagttaattattatcatataagaatcaacaacataagaaagcgttgttgaatttgcacatttctatcatgtatatatatcttacatatataatatatatagattactgtagtgtactatatatttataatgctatgtatacatagatatcttactatatatgtagatatatagtaaacaactgtttcaaatgcattatattatacaatatatattatgtaaatatatacattttgattatatatgtacacacataaacacatacatatacatatgcacacacatacaatggaagttacaaacttctgtcctgcaatgaaagcataaaatattattttcaacttccaaacattttaaattggcaccataaaacactattaaataaatgtcacttgttgtggctcatgcatgtaattccagccctttgggagaccaaggtggaaagattccttgaaggtgaataattcaagaccagcctgggcaacatagtgagactccatctctacaaaaataaaaaataagaggtgtggtggcatgcacctgtagtcctagctactctgtagggtaagagaggaggattgcttgagcccaggagttcatagctgctgtgggttatgattgtgccactgcactccagcatgggtgacagtgagatcctgtctc

SEQ ID NO: 108958 - DNA, 401 bp, Homo sapiens
cttatttagtatattatttagtgcagcacataaattttacatatatttaaggaatctttttcaaacagtttgagccataaaacctagagattgaatttaaaaattgcagatttggacgggcgcggtggtgtacacttttcatcctagcactttgggaggctgtggcaggcagatcacttgaggtcaggagttcaagaccagcctggccaacatggtgaaaccctgtctctacaaaaaaataacaaaaattagccagacatggtagcgggtgcctgtaatcccagctactcgggagactgaggcaggagaatggcttgaacctgggaggtggaggttgcagtgatccgagattgcgccactgcactctagcctaggcgacagagtgaaactccgtctaaaaa

SEQ ID NO: 108959 - DNA, 349 bp, Homo sapiens
gtcgttttacattctaaacatgttgtgtgttaaaccaactggctttttttaaaaacaccttaggatcctcttccaatgaaaaaaacagaaagcatacagtatacgcaataagtggatggttaggacctcttgcttcttcagtatgtctctctgaagagttaaggaaagcagagaaaggtggagataaggttggcagggatgggagagcagtatcccgaggctgagtggagaggcctaggctaagcccctgaaagtatgcttcttgtgatgggtgcagggcctctctaagaatggaaaggatgaatgaagaatagtaggactttagcctgcaggaaggtctataagtggt

SEQ ID NO: 108960 - DNA, 326 bp, Homo sapiens
agtcacaaaatactctttgtggaatagatatctacaggcagaaattttgcaaaaacgtttcaaagcttagcaatttacataattagttttcaactctcaattccatacagagtctcctaagaggaaaattacaaatgccacgtggttagggtttcaacattctgaacactggtattttctccatatagcatacaggaaagagtaaatagttgttctctacaaatctcaggcagcacagtcacttctgggaggctgggagtgtaacgctgcacatcgttgcctgatgtgcatgccaagtcaatatgctgagaccctgggctgcagca

SEQ ID NO: 108961 - DNA, 341 bp, Homo sapiens
cttatatacatgcacactcacacacatgcacgcttgcgtgcatatacatgcactcttatacatgcatgcacactgacaatatacatgcacacatatatacatgcatgcccacacacacatgcatgcttacacacacagacacagacacacacaaacacacgtattctctttctgtctctctgtctctggggcacagcaaccttggcaaaagccatgggaggagggtcctctcctgcttaggtgcagcagcagagaggtccctgagttgaggggcccctgaggagccaccagggaggaggataggccacttcctgttgagaggcccagctgagggagagccc

SEQ ID NO: 108962 - DNA, 419 bp, Homo sapiens
ttctgaatatagatgcccttaacagaaagctctggtaggaattcgagagattgcgaagtaaatgcatggattatctttaatgctgtgaaagtataaatgtcagagtggcaggtcagagagtctcttgaaaaccaatacgaagtgggtaggaagaagaggcagagacatttcacccactttttaggctcactgcctgctgctcagcagggccaccatgatttatctgaattctgtgtcaatttccataactgcatatcactctacaggtacccactgggattacttacaagagattttgctaatgaggatgtacttccgggtacagggttctgtggcatgcatttaaaaaggcagtagctggctgggcgccgtggctcacacctgtaatgtaattccagcactttgggaagccaaggagg

SEQ ID NO: 108963 - DNA, 270 bp, Homo sapiens
cttcctgatttttagtagttttgacatttttactaataatgtttattgaatactttgtcagctaattaataagatcttaaaattattgagtatcagacattgttataatattttacttgtattaccccatctgcacaattctgaagtgggtaacttaccagttttttttttttcttaactcattagaaagaagagttgaataacatggacagggttacacactgaatgtggtacagccatttagtgagaactaggctatttcaacgaact

SEQ ID NO: 108964 - DNA, 472 bp, Homo sapiens
aaatttggtgacctttgtaatgtggaacagtattcttcattttaaataaaatttagagtgattaaaaaaatgattatttacctggggcattaaaccaagtctgatgaggtttttagcttcatttgtgatgtaaaacccatagtgaagattagaagtagttcctgaagtatgcataccttgtgaaatatatttctagtttcaatatctttcctaggggaaatgcccatgctatggaaatcactatgattagcattaattgttatgcttcttgggtctccttgcaaagaagccagacttgtaaaaacgaacctctttttttgccctgtaaaggtcatagcaacagacattgtcttaaaatggaatagtataatggtctcttgactgatttaaatggtaatatgtaataatatacaattatattgtatgggtgatatgggtggtatctttcattaagttacatttctttcatatt

SEQ ID NO: 108965 - DNA, 674 bp, Homo sapiens
cctacagagttcttcacaaggaaagatagaagggatgggtaaagccaagctatcactataaatgtcatgaagctaaattcagtggccttttcagctgatgcagcttatttttattttattttgactcatgacagtaggtggtcaatcaatgcataataataatgtacctctaagtctccatatgctgtcaaacctggatgtgggttctggtaattagcttagcaattgatagcacttgttgtagaaagaatagggaaagaaagacaaatgacacaccaagaaatggatgtgctcacgtagcctaggtgttgttaagcgcaacacataagtctaccccttggaggatactatgtatggaagatttgagttagaagtttgcactgcccagacagggatccaagaagctttgcttggatgaccattttccccaccccaagaaagccatctcaaaatgaagctgactcccaccattccaatcccaccttccgaacttttctgtgaatcacccctcctttagggatgcctttaggggttacacgctctcttccgtgaataatggggaagagcggccacaagagggcgcgttccaaagacttttgctccttgtcagtgtatccagggaaaggcagttgcgcgtactggaagcccctgtctgtagcgccctaatcttggtg

SEQ ID NO: 108966 - DNA, 364 bp, Homo sapiens
gtcttcaattctgcaggttcagtgatctttctaaagcacaaatctcatgatgtcactctcctacttaaaactctccaatggctccctctctggtccagaagatctaaagtccttaggaaggtgttcaaggactctatgagctagcttcccaccttccacctctctcaaaagagctgaaaaacagtttcaactcttttttgggtagaatagcttggtaagggtgctcagttttaatgacctgatggacgggtttaagatgactgggataaggcaacccctccttgtccttgctttcatagcaaacttagggcacaactgggagtggcccagctcttgtatgcacttacctcattcatatcagtat

SEQ ID NO: 108967 - DNA, 555 bp, Homo sapiens
actgaaactgcagaaagtgaaactgtggaaaagagaggactcctgaactaacctggaagtttggagacctagttttaaagttgtatgttataacttagaatatgtattaatttttctggctgtagtttctttatataaatgtaagtggattgtcagctgtacaggcctgggaatctgctgtcctgcaagtgcaagggctctgaggtagagatatatttggcatggtgagaaacaacaaggaggctactgtggctggacagtgtttgaggagggaggagtagtgataggacttcacatttgagaagtaaggggtgggagcaggaggcaaattgtgcagggctttgtaagccattttaaagacaatctttattctgagggaggtggaaagccattggagggatatgaatagagtagtgacatgatgtgacttaaattttaacacggtcactctagctgttgtgtagaatataagtggtaagggaacaagggcaaaagatcagttaggaggaaattgctgtggatagttttgcctaaaatcttataatgcattgttat

SEQ ID NO: 108968 - DNA, 429 bp, Homo sapiens
tttttttgagacagagtttcgctctcgttgcccaggctggagtacagtcgcatgatcttggctcactgcaacctctgcctcccaggttcaagtgattattttgcctcagcctccaagtagctgggattacaggtgcacaccagcatgcccagctaatttttgtatttttaatagagacggggtttcaccatgttggccaggctggtctcgatctcctgacctcagaagatccacccacctcagtctcccagactgctgggattacaggcgtgagccactgtgcccggccagagactaagagttctttatggtccacacacacaagtaggctcctgtggctaatcacaacaatacctagtatttctcaagggcccactatgtgtcaggcactgttccaagtgttttaaaagttgtcatcatttaataaca

SEQ ID NO: 108969 - DNA, 547 bp, Homo sapiens
aagaccaatggaagcgggcgttgctggtcgctaagagaaccctcggcggcaagatggcagcggcgggcgagggcaccccgagctcccgcgggccgcgtcgggacccgcctaggcggccgccccggaacggttatggtgtctacgtatacccaaattccttctttcgatatgaaggagaatggaaagcagggaggaagcacggtcacgggacagttgtaatttaacgatggcagtcattacgaaggggcgttgtggacggaccgagatcacgggagacggccgcggcacgtgggcctggtcccggagacaccttctctggacacgttgtactgcgaagagcccatcaacaggctacggcgtacaagagagtacaaagccggcagaatgtcctgaaacgggaggcctcccaggggaatgggggaagggcaacgaggataatggaggacacgagatggagcagcgacccaggactcccccaggacaaccgaggcacagaactgggcagatcactccaaaacgggacaagacgacgccacccgccccgccg

SEQ ID NO: 108970 - DNA, 461 bp, Homo sapiens
ggcagggtagggatgagcatcttcattttcttcattttacacggaaaagaaatctctggttgaacgtggtcagtgacttgcttcagctgggagacttgggactgaagctgccctctgtgactctgcactctgtccgtgataccagggaactggtgaatccaggagcctcccattgtgatgctcactccttctcctgtccattcatatgggtaaaaaaggttttgtggcttaagtagcatccagtttcatctcaagtttcagttcccataaaataaacagatactagggtagcaaatggtcccttattaaatgtcacaggggaaaaagagaacaaaaatcattttctgtactctccagaatacagttgagtgtcccgattgcctcatacctccagtgagaacagcagcagcatttatgggctatctcagtgagccacttttctgttaaacaatccaacacgg

SEQ ID NO: 108971 - DNA, 256 bp, Homo sapiens
ctgctccttcccagctgacacgtgcagctgtccgggggcctcaccctctgtcctggagatcgggtttcatgatggccccaaggagtactggctgccccagggcctggtccctgcactcacctgagtggagccatgggcctagagcctaggtccccacctctggaacctgcaccctcctggagagcaccatgcactgcctgccctggaatcctgaaccctgccttccccaatctgcctttctcatcctgactccctg

SEQ ID NO: 108972 - DNA, 404 bp, Homo sapiens
gagacgccaagacagctgtgggagaaggaagaagaggagggctctggaggaggccacgagccatctttgggaccccagcctgcggcagcactgggtccaagggggtctctgtcctgactggagctcgaggaagggctagaaggtgatctgaggtcaggcacagtctccctgtgctcaagggtcctgggcaaggccagggagtgcaggcaggactctcagaagaaatgggcctagggttcagggcaatgtggttgtttcctggtgttggaggagttcagagctggaggctcagctggggtcgggcagggaaggggctgagccgagactagcgttgtgctatgggtgtggctggcactgacatttagaaaaagactgggtgggactggaaccagggctaggcataa

SEQ ID NO: 108973 - DNA, 400 bp, Homo sapiens
tgagacagactctcgctctgtcacccaggccagagtgcagtggtgcgatctcagctcagtgcaacctctgcctctcggtttcaagcgattttcgtgtctcagcctcccctgtagctgggattataggagcccaccaacatgcccagctgatttttctgttctagtagagatgagattttaccacgttaaccaggttggtgtcgaactgacctcaagtgatctgcccaccttggcctcccaaagtgctggaattacaggtgtgagccaccatgctcagccaggatctccttttttatggccaaatactattccatagtgtatataaaccacagtttctttatccattcatctgtggggttttttgttttttttcgagacggagtcttgctttgttgctcag

SEQ ID NO: 108974 - DNA, 312 bp, Homo sapiens
ttcctccctaagattggggaaaaggtatagatgtccactacttctattcagcattatagggaagtcttaatgtcttattcagaaataatacaatttgcagaaaattcccaaggaatttgttaaaaagttgctggaacttaataaatgagtttaacagtacaatttctgtgtgtttaagctcaacatatagaaataattgtatttctacatacagtgaacaattagaaactgaaatgtagcgccgggcgcggtggctcacgcctgtaatcccagcactttgagaggccgaagcgggcggatcacgaggtcagg

SEQ ID NO: 108975 - DNA, 1686 bp, Homo sapiens
  misc_feature (1677)..(1677): n is a, c, g, or t
  misc_feature (1679)..(1679): n is a, c, g, or t
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagtctgacccttggttatcattacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatnanaaaaaaa

SEQ ID NO: 108976 - DNA, 582 bp, Homo sapiens
  misc_feature (573)..(573): n is a, c, g, or t
  misc_feature (575)..(575): n is a, c, g, or t
tgaaaagcattgtttaattgcaggtaagaggaatcttctctttcctttaggcttatagtctctaaagtgaaaatttggcaggatatagtcatgcagctcataatgacattccaatcaaccacagactgcatatacagcagtggtcctataagattataataccatatttttagcatatcttttctatgcttagatacacaaataccattgtattacagttgcctttggtattcagtacagtaacatgctgtacaggtttgtagcctaggagcaatagtttatattatatagcctaggtgtgtaggagcctataccatctaggtttgtgtaagtacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatnanaaaaaaa

SEQ ID NO: 108977 - DNA, 636 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacgtaagttaacatataattttacaaagttacactgtcagttttctgtttaaccactgctcttaaaaaatacactggctcatctattcttttgtttttggtacttaaggaaattgtttggtctcttttttcttggaaaagtaggt

SEQ ID NO: 108978 - DNA, 493 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtggtaagtatcctttattccatttttactggcttgatgatgcatttcaataggcctgtactatacctgtttatgatttcatgcttcc

SEQ ID NO: 108979 - DNA, 1797 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108980 - DNA, 1827 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108981 - DNA, 1737 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacgcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108982 - DNA, 1743 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcgcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108983 - DNA, 1478 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108984 - DNA, 1106 bp, Homo sapiens
aaatgttcagaggtggtggctagctggagggaaaaaaagaacgcataagaagaaaatcagtgagcatttcactctccatggaaatagtattttattaacatagtgaaaagcacacactgctttggacctgtgaacttagtgttcagtgttcatggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108985 - DNA, 996 bp, Homo sapiens
  misc_feature (1)..(1): n is a, c, g, or t
  misc_feature (19)..(19): n is a, c, g, or t
  misc_feature (26)..(26): n is a, c, g, or t
nttttagggggtactggtnggcggangctgcttggtcataccaacacacgccaattcaataccatacctcctcagcttgctccgtgggaattaatgccattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108986 - DNA, 1120 bp, Homo sapiens
attttcaaaaaatatatgtagatatctctatatatgttatatatacatttttaaatttttaattgggtagggtatataaaatggtctttctaaaatttcacatttaggaatctatgataacaacagttttcttcatgcttccataaaaaaaaaacgattgggaactaaggatagaactccttgcattttccatcagatggtactgattcactatactgtataaaagaagaggaattttttcagatttaaaaactcaggagctatatgctggaaaatacatatagtatacttcacttatttaaattaaaggagtgtttaatttataaatgaaatcttacctaataaaggctttctttttatattttgtttcaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108987 - DNA, 1260 bp, Homo sapiens
  misc_feature (1251)..(1251): n is a, c, g, or t
  misc_feature (1253)..(1253): n is a, c, g, or t
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattatattatatagcctaggtgtgtaggagcctataccatctaggtttgtgtaagtacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatnanaaaaaaa

SEQ ID NO: 108988 - DNA, 303 bp, Homo sapiens
ttgttctttgaaattgagaacacttatttttatcattattactatttagtacacattagaattttccaaaaattcatgtcaatgtgaagtcaaattaataagttttatatgacctcctgagcttacaagtgaccttttaatcatcatcatcacattatgatcctagctacatctcaaagtcaacacagaggaaaatacgttacaccatttagagggaaacacctaacagagaaacaaggataaaatggtaacaagggaaatctttcccacagaaatgttcagaggtggtggctagctggaggg

SEQ ID NO: 108989 - DNA, 293 bp, Homo sapiens
acttgacaaaaaatcatgaaataaattcattttaggtcagtgtccatattgctacatgaatcaaaaatttttttgtcctattcgtgttccagataccatactcctcagcatctcctgggaattatgtagtaagtacatttgggtttgtttgcttataagaattgatgttacattttatttgggcaatgaaacagttgtccagatgttaagaagagcccctgtgtttggccaagaagtgaacatcttgagttgtttcatctgccaacctcagtacatatgttgatgttcattag

SEQ ID NO: 108990 - DNA, 354 bp, Homo sapiens
taatgatgagcctctgggtgcagggagaggataggacttgatgctttccaggggaaatatttaaaatttcagtactaagttaagtctgtatcattttactttttttatagtttcttattttatgttgtatgagatgaaaagcttgcacataaaagatgataagaaattagaattcatcgtttctgttgtaccaagaagaaccttagtgatctctaaaagaattgttgttaaaatatggattcttctttccttctagtactcccctagcatgacaatgagcgtgtgatccattaccaagtctcctcatgaaaaccacagtgagtcagcccttcacagaactactacggaagaaaa

SEQ ID NO: 108991 - DNA, 751 bp, Homo sapiens
actctttcaaaattgaattttggatttatgatatgtttcatttgaaaatgtttactattgtacatatcttaggatattaataaaatatattgaaatataattgcagccataccttaatcatttaacgtgctccagtgatcatacatattcacatggttttaaaaagacatagaccaaagtaattgctaaaatagaagcaaaaatacaagaatggacccctcagagaatgaattacacaggccttatccaattggagttatgtagggaaatcattaacgtttaacgtgctctcctttctttcccccctcctctttggttttgtttttttgttttgtggtagtctgacccttggttatcattacagaactatggaggtgcaatgagacccccactgaatgctttaggtggccctggaatgcctggaatgaacatgtagcaatgttatatcatatactacattattacgtggatgatattttatatatataataataccatattattctatttagtaaagtgttctattttctggcctctaaaatgacgttaatttgtaaaacaatttgagcaccacagtctctgtgtggtataaaaatgaactaaacaagagctgtagtgtttgcttcattttcacaacataatctcttatgttttctttgttcccttgcaacctttaattttttttcattttcaagtgctataaataacagcttttagtctatttcattttgataactacagagtctccata

SEQ ID NO: 108992 - DNA, 1887 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108993 - DNA, 1911 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagtctgacccttggttatcattacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108994 - DNA, 1978 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaaaattcatctgtgccttattccagttcactcttgtaagggtgatgcttgtgatcccctcagccctcatgtattcattcgtattatattggaggttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108995 - DNA, 1476 bp, Homo sapiens
caggaacccgtagatcagcggccatgcgctgagtcctgcgagatgtaaacactcatcataagcataggtcttccatgagtacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagtt

SEQ ID NO: 108996 - DNA, 2858 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattattcatcacagtgtacagttaaacaaaggaatctcagtcacaccaaaccaacctttttatttcctgctctctcccctcttttgtgaagaaagcgggtccaaatgtgattcaaacaactgtacggagtggcatattagaattgccctaaactgaactgcaaataattatgtgtgtatgtatatgtgtgggaaagagaatgtactgtatatgtgtatgttatacagacatatacacatacatacattgacccacaggacattgtaaaatattatcacatgacatcttaagtagaaataagtagggacttttattccatcctttttttcacgtttacattttaattattacaagttgctcctgccccctccctgaactattttgtgctgtgtatatcactgctttatataagttattttttaaggtgaactcagatgttatggttttgtaaatgtctgcaatcatggataggaataaaatcgcttatttgagagctttcattaaaatgcgtctgatgcaagttatcctgtgaatcacaaagtgtactgtctcaaaaaatagaagaaaatgtgtcttcgtctttatgttgaatcaaacaatttctcagttaccttcagtgaaaagtatttttttaatttttatttgagaaaaacacttcaaatcagtaaaagcttaactggggcctcacacagtatatttctgcaataactgctttaaacggagttcttgatttgtttgtcttagatgatacagaaatcattaaatagcccaaatcatttagaccatagcaataaagtgaccggggttgtcatatatttagcaacatcttttctctttaacatgatgaagcccaaaagtgataacaaaagcatttgcttgaatttgtcacttctcaccaggagtactagaggtaaatttttaataacatactaatgtgaaatggtatctggtttttattcagactttttgtgagcatattcttatagacactagaaataaatacatagaaggagactttgagcacaagggagaagagagttattagcactcctgaggcctctggaatgctgcttttctatccaggtatcttgcttgctaccagcagaattgactggtattggttctcactggccagggagcctctgctctgttcctggaatataaggcttttattcaggagcaaatcattgatagtaactttgctttatctagccattgacttcagcaggctaaaactacattgtgtaactgactgttcaaaaaagaataagtaaattttttttaatctaattcccttatggaaagcaccttgctctatggcactttccagatcttttgggattttgtgcttaattatacatacatacaccaaaatcacaatagaaagatatggaaggactttaattttagactctgaaagataactgggtgatcctttgtgttaaaattgtgatacaaacaaccattgataaataccaactatgaatccaaact

SEQ ID NO: 108997 - DNA, 1669 bp, Homo sapiens
  misc_feature (1660)..(1660): n is a, c, g, or t
  misc_feature (1662)..(1662): n is a, c, g, or t
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtgtattttgggatctctactgtgcagctccagagagacgtgaaacatgtgaacactcaagtgaagcaaaagccttccatgattacagtgctgcagcagctcccagtccagtgctaggaaacattcccccaggagatggcatgccagtaggtcctgtaccaccagggttctttcagccttttatgtcacctcggtaccctggaggtccaaggcccccattgaggatacctaatcaggcacttggaggtgtcccaggaagtcagccattactccccagtggaatggatccaactcgacaacaaggacatccaaatatgggtgggccaatgcagagaatgactcctccaagaggaatggtgcccttaggaccacagaactatggaggtgcaatgagacccccactgaatgctttaggtggccctggaatgcctggaatgaacatgggtccaggtggtggtagaccttggccaaacccaacaaatgccaattcaataccatactcctcagcatctcctgggaattatgtaggtcctccaggaggtggagggccaccaggaacacccatcatgcctagtccagcagattcaaccaactctggtgataacatgtatactttaatgaatgcagtacctcctggacctaacagacctaattttccaatgggtcctgggtcagatggtcccatgggtggattaggaggaatggagtcacatcacatgaatggctctttaggctcaggagatatggacagtatttccaagaattctcccaataatatgagcctgagtaatcaaccgggcactccaagggatgatggcgaaatggggggaaatttcttaaatccttttcagagtgagagttactcccctagcatgacaatgagcgtgtgatccattaccaagtctcctcatgaaaaccacagtgagtcagcccttcacagaactactacggaagaaaattatattatatagcctaggtgtgtaggagcctataccatctaggtttgtgtaagtacactctatgatgttcagacaaggacaatattgcctgacaatgcatttctcagaatgtatacttatcattaagtaacatatgactgtatgtactagttcctgatgacttacttctctcaaattcataatgatttagtccttgtaaaaataaagattttgcctgtgcctaaacagggatactaggcagaactgttgagaaaaaaaagctgaattaaatttatgttgcagatttaaactatnanaaaaaaa

SEQ ID NO: 108998 - DNA, 484 bp, Homo sapiens
ggcttagccgccaccgcgcgcttcggaaggccagagggagggggaggcctgtcagtctcgcgcgttgcctgggcgaagggggcggagctttggcgtggggcggccaatagtgggggtggctgcgtgggtcgccatggggacggggctgttcccggggaggctgtgatgggttgacaggtgcgtgacagtgggagctgctctcggcacaagcatgtacggcaaaggcaagagtaacagcagcgccgtcccgtccgacagccaggcccgggagaagttagcactctacgtatatgaatatctgctccatgtaggagctcagaaatcagctcaaacatttttatcagagataagatgggaaaaaaacatcacattgggggaaccaccaggattcttacattcttggtggtgtttcttgatgatctcaatctcctgacctcctggatctgcccgcctcggcctcccaagctgctgggattacaggcgt

SEQ ID NO: 108999 - DNA, 301 bp, Homo sapiens
aggttgtacatttaagtctttaatccatcttgagttgatttttgtatatggtgtaagaaaggggtccagtttcagtcttctgtgtatggctagccagttatcccagcaccatttattgaatagggagtccttttcccattgcttatttttgtcgatgatcagtcggttgtggggatgtgactttatttctaggatgtctattctgttccattgatctgtgtgtctatatttctactactaacgtgttatttttgttactgtagccttgtggtatagtttgaagaaaggtaatgtgattgct

SEQ ID NO: 109000 - DNA, 356 bp, Homo sapiens
tttccactatccaacttcataaaaacaattttatttgaactcttcatatatatcttcaacatcagtgtcttcttccatcacaaaaatagtttatcaatctaaaaattttccatagcacatcatcttcagtttggctcaaattgtaagataatacaccatctaaatcatctatgatgctgtcactaaaattcttttccaagtcataagtagtcactcatgtgacagtaggacagttgttttttatctgtcctctaggtataatgtgatttgtaaaatgtaacacttgctatgttgctttcttagtgagatatacaaggttcatttgttctgacatctaacacaaccattagtcagac

SEQ ID NO: 109001 - DNA, 463 bp, Homo sapiens
agttgacaaactcatcaagttacagaatctttagcatatgcatactctatatgagtcaagagctgaccttttcaaaaaaaaattatactttgacagccgtatatatatatatataaagcaacataagacattttaaataacaatatataaatttctatcctgttgtttttaaaactagaaacagggcaattaaataatcattcaatatatgggcaaaaggattccaccttatctttccctcctgccagtggtgcagaaagtggtcaagggagagtggtggatgaagagggataggggagacacagcccttgggaggggtcctctgtctacctggacttgatcaagctgcagtatgactcatcccggcatcggtgacattgcactggggattcctgaaatctcatacagttttccatgaatgattttggtttccatccagcagttcttatcattgatatgaaac

SEQ ID NO: 109002 - DNA, 203 bp, Homo sapiens
cattttcatatttgtttaaaactaacctcaccatcttgatagtgtgtgtaccttattgaaatggaatctaaacatattccttgtcagtaaatgattcagtcagtaaccagctacctacttccaaggcaaaagaaaccttttagagcatctcctattcatgaatggcattgagaagaaaggcatgaaccatatgtatcacaaag

SEQ ID NO: 109003 - DNA, 158 bp, Homo sapiens
gcacagtcacagatcattttttctggccatgtgcctttggccttatgtgtgaatctgggtctgtctgataggtggaaaaccatggactttggaggcagacacttgggttcagatcttgactctggccctaactaatggtgtgacagggaaagttattt

SEQ ID NO: 109004 - DNA, 348 bp, Homo sapiens
cactgagctttaatactgaggaatttttagttgtggtaaaagtttagcaaagtctctattaaataatttacacattctgggaatagggaaaggaaaaagtttttattcaccaccactctgtattcgggatctatatatactaaatagttcatgtgtttactctttccaatagtgaaaaaacagggttttatcacagaatttttatgaaaaccagaaaagagtaaagagcctttattatctccttgctcttttggagcaagatctagtaaacgtctcaacagaaaaagtagcagatgctttgtaaaaaggtctcatatcacttatgtccaattatagaggctgatttgc

SEQ ID NO: 109005 - DNA, 235 bp, Homo sapiens
acatgtttgagccactgcgcccaaccttcagcttacaattgttaagtactcagaaggcctctcgccagttaaatccacaatggctcctccagtcattactacgttagcaaaacatgtatcatgccctggcatctcactgagttctatattcagtgcctgtctcttcactgccacagcataagctccccgagaccacaggcttcacaggcacagcttttcagtgtccggcccggta

SEQ ID NO: 109006 - DNA, 295 bp, Homo sapiens
ttcccacagattgaggttcttgctccaaatactcccaaactctacttaccatctgatgtcttaacattgctaatataagttttatgaactatttcattgaaatattttcatctccttgactaataatgttgaacatcttttcatgttctcagtcatttagacttcttcttttgtaaaaagtttgttcatgtcttataagcagtatactgaatcttttgtgtgtgtgtgtgtgtgacagtctcactctgtcgcccaggctggagtgcaatggcacgatcttatactgtttttttgt

SEQ ID NO: 109007 - DNA, 374 bp, Homo sapiens
accaactagaaactccaatatagtcttctgtttttatgtcaatgcatttgcaatcagatttcagaatcctaacaggtaaattggagtctacgaaaattttataataattgcttcatggactctgagctatagtctatatcttagttttttcaaacattttgactattttgaccaagccagcttgcagtacagaaaaaagtgaaaaatgtttctccttctgaatgcattcttaccactttgattctttctgtttctactatccatataaatacttttctgacccttttgttagacaaggaaagtttcttttgttattttgttttgttaaatgtaaggaatgagacaggccaaacagtgaagataaacaatagatc

SEQ ID NO: 109008 - DNA, 1077 bp, Homo sapiens
ctcatcaaatgattgtttcagttatttaatcactcatgagagaagaaatagtacacagatgaagttcaacagtgtttcaattataaaaactcaggagaagtaggaaatgctgcagtaaccactgaggtatgttatttgtatattatagatatgatactagcacaatgcacataggtcaattaccctcaacttaatttaaccttcatgcatgtcatggataagaactacaaagctcttgtgcagacatggaactttgtttaatgtgctatctaaatggcaaattaagtaattgtttgaacggctttacatatttgaaatattaaggttttcactaaaatatgagaatgtaaggattatgtaaatcatctttaccctgtgtgactggtcatcaggatattaacatgatgcaaacattactttaaaaacactagatacagtgagtagacaacttatttaaataattaagtggcttattaatattcattggctattatctattttgtctctgaattaaacaccttccaagctctaaagtgtagtgcagcacgcatttgtaaacagtcaccttccctagtacttttcttcaaaatgtttagtttatggcactcttttgcctttaaatggaattactgacctgagtttattaatgattaggaagatcacatgtctcctttcacattctatgatgttgggaaagatagaatttacaaagcctgcaaggaactctatatcagagtaaccataaaaacagttatacttagcttgaacaactaataacacacagcaactagatttggtcatgtacattgggaacatgagtttgtaattttaaataataagccctaactaaatagaacttggttaaagaatgcctacaacaaacatttagttgataggaagaaaaccttttatttaattcacttttatatggatatatggttttccattggtactagcttactgcaatctccacaataatcacagaagttaggtacagaagatactatctatctgttacagatgaagttactcaaggattgtgaggttaagttgccgccaatcgaggggatctctaga

SEQ ID NO: 109009 - DNA, 334 bp, Homo sapiens
tgatcacacatattcccagaaggagaatatgactcatctctgaaggtctaaatatatatattgggatgactggtctaaggcatcatggaaggcaatggtgcataatgttctaaattagaattgtccattaagaagaaaaaggagggggggctaggcacaatgctcatgcctataatcccaacactttgggaggccaagaggggaggatcgcctgagcccgagagtttgagaccagcctggacaacatagtgagacctcatctctacaaaaaattaaaaaattggtgggcatggtggtcatgcctttagtcccagccattgggagaccgaggtgg

SEQ ID NO: 109010 - DNA, 561 bp, Homo sapiens
cagaacagagtggtctcccaccccagctctacccttggctgcctgtgtcaccctgggtggctttcccagcctctctacctgcttccttcttgacagcctgatggtggccatacgtcccttgggctgtggtgactgggcctctgggagctgcccttccacttctgcattttaacataaacctccttgacctcagctgctccattctctgctcccttccagccactcggattccagtcctgggggcctcctcactgaccatgccctccaccctcagtgctgttccctggtactctgcatggcttcctcacctgtatcccgtctttgctcagacgccacccctttagagacctccctgactgtgccctctgaaagagcaccttgtcactctctgtcccttctcccacttgtttacttgtatattgtgttcccactagaatgtcaactccaggagagcagagactcttgtcttattcactgctgtgtccctggtgcctagaacagtgcctggcacctgctaagtgcatattaaggagtcgttgctcactgggtagaagcattaaa

SEQ ID NO: 109011 - DNA, 371 bp, Homo sapiens
gagcttccaactcactttccagccacctacaggacatctccccatgtgtcgtatgtctaacacacatatgtccaaaatggaacataccatttttctcccttctttagctcccatttcattaaatggcaccacaatcttaaatgcccatccagaaacctgagattattacccctcttcctttctcagacctccatctaatcaatccctaaattccgttcatcctacccttaaatagctctcagatcagtccacttccctccatttccaaggctcctagcctagtccaggccacattgccatctctcaccccagtgactgggacagcctccagctggtctccctgcctccggtccttcctctacaggatgttt

SEQ ID NO: 109012 - DNA, 686 bp, Homo sapiens
cgtggtgcctcacgttgtaatcttactactttgggaggctgaggcaggcagactgactgagctcaggagttcaagaccagcctgggcaacatggcgaaaccccatctctactaaaaatacaaaaaattagccaggcgtggtggtgtgcgcctgtaatcccaactactggggaggctgaggcacgagaatagcttgaacccgggaggtggaggttgcggtgagccgagatcgtgccagttcactaaagcctgggtgacagagtgagactctgtctcaaaaaaaataaaaataaaaataaaaataaaaataaaaatacaaaaactagctgagcatggtggcatgtgccggtagtcccagctacttcgggggctgaggcaggagaatcgcttcagcctgcaaggttgaggctgcagtgagccatgtttgcaccactgcactccagcctgggcaacaaagtgagaccctgtctttaaataaaaaaagaacatatgaagcaaaggatactaagtccaacacatggcgtaacagaccacatcctaagactacctaaaagacaaacatgaggatttcctgatacagggccatttgctttggtttattttgttttaattacatttatatttttaaaacagataacatattcacaagaaagaaaattccaaaggcttgtgagtgaaaatttttct

SEQ ID NO: 109013 - DNA, 322 bp, Homo sapiens
cctctctgtttatgtggcaaagaatagggaccaaatactatctgaataaatgttccttatagccacagcatgcttgacttagatggtctgtttctccagcctgttgaagaactgtagctcacagatgtagatttcaaatgatatcctaaattgctgctttcatcatcttagtgcctgtaattttctgtggctttagaattgatcacatgtatgagacgcagttataccatttaagcatcaagcactagatttggattagcagtgtttatactttgtattggtatgcagtcattccttttttttttttgagacagagtctcac

SEQ ID NO: 109014 - DNA, 742 bp, Homo sapiens
attttgtttgtgttagttcaaacagctggtcattaatgcagtccccatttctagagcgaagtgctgctggacatgaatgcccgcctgattaatgctgcccctccgagggtccttcacccagcagtcatgctcgcagcagaataatgtagcatgatgtgattgcactctaacaggatagtatgtcattgtgtcaccaagcaattgaggttattatggggcagggcagacagacgggacagtggggttactagaccgtagcatttttagaaatacaggcctgacctacttagagttattctctctggctggcagctgcatggtacataaagtctcctgataggctgagtctgttgctagggggaattagcatgaatttttccacacacagactcagtggctgaatgataaaagctgactggaattaaagagatttggtttagtattatacagatttatgtgcctccttttctttctcaagtgcagagaaagagtgcaaaacacagattttgtttccatttgttctttgaccttcttgttctctccccctcccctcaagatgcatgaggggaggagggcagggcagttatgaaattttggttaatctctcactgttggggtcactgaaacgatgtcgcaaattgcaagatatttaagcttaaaaactgttgggaatgactaacagaaggttagattatttttcctcttctgtgcactaagctgttttgaagttgggcatgcatct

SEQ ID NO: 109015 - DNA, 803 bp, Homo sapiens
ggttgctgttatcctccccattttacagagaaggacatggaggcccagagaggctacataattttctctgggtcccaaaacctgtaaatagtagagaaggggatcaaacttgtttatcttactctaagctaccccactctttctactatacctaatgcctcttagaatgaccctggacttgttgatttgtcagctgcttgcccttggcgggagggcgtttggctttctttttcagataggagagaaaacatgagaggagaaatcagcttctgcagagattaccttagagattgagcaaggcagtgtaatgtaatgaaaacatgcaccagagcaggggcctctagccccaggggcaggcttgcaattagaactgggctaaaagaaagaaaattgtgggagggtccaaatgagtaatatgggaaacatgctttttgtttaactgtgatacctttggtatcacagttttgtgattgatgtgacttaggctgtttgcctctttcattccaagatgacacacctctgtggggttactttgtgttcattctggacctggatcattttcagggggtccatgctagaatgtactgcaatgtgggaacattggcctacagatctagttaggtcctctcccaccgccatgcgcttagtcacttcacctgctgccttccaaaacaaatgggctgtgtgtgtctccttcccttaacaaagtattctataatcatattttctagcttaaaacaaaattagtcttttagatgtaaaacacatctaaagcacttttattaatggatcgctttccttca

SEQ ID NO: 109016 - DNA, 668 bp, Homo sapiens
gagaaaatataccatttcagaaattattcttaaggatgatttaagtgaagttttgttaagacacacttgaggttctaaagttattttgagagtttaagtttgtttcaaagaaaaatagtgtaacaaaataaatagaatgtgagggatattatttattataacagaattaacctgatgcctaaatttatgaaattcagaggaatccactttttgttgttagaaatgaatgcttttgtcattttggatggtttttattaagattggagtggtcacaacttcaaaaagatattggaaattttaggaaagagtgagaaaatccacccaagataaactgtaaaaccttttttttaaaagaaaacttcttatgataacagaatgataacatgtggtgattacctttacttactagtgaaagaaatagcttaatatataagctactctcatgacatctaatggctagcagccagggatgctgctaaacatcctaaaatgcacaggatatttccctaaaaaacacattatttggctccaaatttcaacactccaaaaccaaacaaatatattacaggaaaagaaactacagaccagtatcttttgattataggcacaaaaatcctcaatgaaatataagtacatggaatcaggaatataaaaacgattgtactcca

SEQ ID NO: 109017 - DNA, 136 bp, Homo sapiens
tcggatatggatggttcagcgttagaaagacttgaaaaaacaaaatgagtcctccttctttgaaatgttaaagatatgataaaacctatgccatcaagtacattcgcttgacttaaggccttctaagacagacctt

SEQ ID NO: 109018 - DNA, 372 bp, Homo sapiens
attttaaaatgtaaaaagtaataaaaaatctgtgtaatacatgacaatgaaattcaaatttcagcgttcataaagttttacagaggtacagccacacccattcatttacctactgctgcttctacgtgatgccagcagggttgagtagttgccagagaccatactgccccccaaaatgtgaaatatttactacccagttctttacagaaaaagttcgccaacacctactcaaagtctggtcggtggtaattgtttgttaccaatctgcgatgagataaacacagaaattgagagtaagactttagaggccaggcacggtggctcacgcctgtaatccctgcactttgggaggccgaggtgggtggatcacct

SEQ ID NO: 109019 - DNA, 203 bp, Homo sapiens
gctgtaactgcgctactcggacagaatgaacccatcacttgctgtccttctggttcctcacccacttcatatgacatagctggtggctgtgcatgtagaggggaggctgggcgctcagtgcaaagcacaattgtttacaaccttcctggaaatggctgttctctggctggaggctggggccatttccacgatgcccaggacag

SEQ ID NO: 109020 - DNA, 265 bp, Homo sapiens
ctttgctaatggcaaactcctacttattcttcaaaacccagctctgatagcatcatgcttctgcaatgcctctgagcagcattacttgccctctcttctgtccttttcctccatgctcttctctgatatgactgtgaatccactttctgttatgtctctccaccagatcacattccgtgatggcacacacaatttatccaaactcctgatacacaagcactcctcttacagcagacattctggaagaagtggttttcaaccacag

SEQ ID NO: 109021 - DNA, 353 bp, Homo sapiens
ggaattagatattgccattagcagagtcacaaatagaatttactaacttctttgattactgcaaattgtaagttttctgacctaagaaaattctctgattgctaattggcagcaaaacttctgtttaaaaacacagtaagaaatacaggctagatttattgattctatgatgttcagttaaggtagtaaacctagaagtattcgcctaaagagaaaaacattcttgagtttgcagattgccatcttggtaatatagaaggcatgccatatgcacctgatgacactttattgtatctgtttctatctaaaaagccttgcacatttgcagttgtaacctaattcagttctcatgg

SEQ ID NO: 109022 - DNA, 1085 bp, Homo sapiens
aacctgcttcctgagtttcttaaaattgtgtctggaactcagatttgcactgcctagtatagtagctgctggccactgctctgttgagcacttaagctctggctagaacatgtaaaatacatatcagattttaaaacttaaaatgggaagcagactaaaatagctaatcaattttttatcttgggccaggcacagtggctcatgcctataatctcagcattttgggaggccaaggagagagaattgcttgaggcaggagttcaagaccagcctgggcaatatagtgagacccctgcctctacaaaaaattttaaaaattagccaggtatggtggtgcacacctgtagtcccagctactcaggaggctgaggcgggaggatcgctagagctgggaggtcaaggctgcagtgagccgtgattgtgccactgcactccagcctgggtgacagagcgagaccctgtcttaaaaaaaaaaaaatcttgactacatgttgaaatagtattattttggatacattgagttaaataaatacatttttaaaacttctttcctctgtttctttgtacatttttcatgtggctacaaaaaaatataagcttgttgtaggtttctgttggacagtgctgaattgccacagctaacaccaagatgatagttgtttattatccattctcactgtcagaaaacaagatgcttggggctctggttttgtttgcttatttttttgtttttaaacagaagttttgctgccaattagcaattagagaattttcttaggtcagaaaacttacaatttgcagtaatcaaaagaagttagtaaattctatttgtgactctgcttatggaaattctaatttaaaaacacagtaagaaatacaggctagatttattgattctatgatgttcagttaaggtagtaaacctagaagtattcgcctaaagagaaaaacattcttgagtttgcagattgccatcttggtaatatagaaggcatgccatatgcacctgatgacactttattgtatctgtttctatctaaaaagccttgcacatttgcagttgtaacctaattcagttctcatgg

SEQ ID NO: 109023 - DNA, 700 bp, Homo sapiens
attttgaaggggtgctttctgtaaggaaaatgcgttataaatttagcctccacctgggtgacagagcgagaccctgtcttaaaaaaaaaaaaatcttgactacatgttgaaatagtattattttggatacattgagttaaataaatacatttttaaaacttctttcctctgtttctttgtacatttttcatgtggctacaaaaaaatataagcttgttgtaggtttctgttggacagtgctgaattgccacagctaacaccaagatgatagttgtttattatccattctcactgtcagaaaacaagatgcttggggctctggttttgtttgcttatttttttgtttttaaacagaagttttgctgccaattagcaattagagaattttcttaggtcagaaaacttacaatttgcagtaatcaaaagaagttagtaaattctatttgtgactctgcttatggaaattctaatttaaaaacacagtaagaaatacaggctagatttattgattctatgatgttcagttaaggtagtaaacctagaagtattcgcctaaagagaaaaacattcttgagtttgcagattgccatcttggtaatatagaaggcatgccatatgcacctgatgacactttattgtatctgtttctatctaaaaagccttgcacatttgcagttgtaacctaattcagttctcatgg

SEQ ID NO: 109024 - DNA, 719 bp, Homo sapiens
ataggaattgtgttaaacctacagatcaatttggggagaatttctctctttactatgttgcgtcttccaatttatgaacatagtgtgtctctgctttgattcctttcaatagcatcttagattttcagcatagaggacctctgctttttaaaaaatcttgtcaatcagttggttaattctgaaacatttaatatgcacttactatgtgctagtaccatgcttggtgctagaaatacaaaaatgaaatacaaagctttaagaagccagaaggacagagtttgagaagagcatgttgtctgaactggcattttagctaataaaagcagaaaaaacttccccctccaaaacaatacaattacagtgaaattggaaattgcctaatatttattattagtaaaagaatcacgagatagaacatgtttgagagtacagtctttggaacaaggcagatctgagtttgaaacttagctcaggctggtcatttgactttgggccagttgcttaagctttagaagcctcatttaaaaaatctgtaaagtaggatgagaatatactgagctctgagggttgttgtaaagattgaagaaaacatttgtgaaacggtataatgcctgccacatgtcaagtgccctggtataatacaatacagttatttttattattagtttcatctcacttaagggctaaggaaaaaaatgatagggtagaagtggataatg

SEQ ID NO: 109025 - DNA, 394 bp, Homo sapiens
aaggttcaagacatcatgatattgctgaagcagaataacttggctatgaaaacaatcacaaagattgatttcgttttaaaaatgatgacccttcgttaaatccaaggaacattcactaaaaataccaacctagatcaatggcaaactgtaatatcaagaaattggcatagaatggattaagcgatactttgaagaaaactttggagacagattatgccaagtccacaaggcaacagagtcaaaaacagctgcataccaacatgatatgagaccattctatgtagctggaaattaatccatggactacactagatttccatttgaagatggtgctgccttcatcactgagcactcaacattcatggattgataggcacagcacttcagcacaata

SEQ ID NO: 109026 - DNA, 142 bp, Homo sapiens
gtgactcttctggagctctacaagtttaaaagccctttgttttaacttcatattcagtagaaaccatttaacacaggataaactcatagttacattaaaagataggaaaatacacacacacacacacacacacacacacaca

SEQ ID NO: 109027 - DNA, 816 bp, Homo sapiens
atcttcaattgaggttcttctcttccctttgccagcctttgcatggagtaatgaacaggcctgtgttagatgtagcagatgcacatctcctcatgggccagaactcttgattcaaatcacaggcttgccgagaattatcacagagatgagaatcctacattaaaatgcacttttgtcttactggtaatgatcacagacctcattacatcatttatttgtatacactaagccataaacttgctttagccaggattacctcaggattcctcgctaaacacaaggcaatcttgttggcttagatcctcccacttggctatatactctttgcaatttcaccagaactttgccaacactctactctgatgtgtgctgtgtagaagtagaaggaaaatagctaaatcaagagaaggaaagaagtaatttacaaatttttcatgattagcattattgttttctgttggacttgtactcatcttggtaaattttacagattataattcaattttatttttatcaattcttattttctgagtttttaagttaggaaagaaatttagttaagagggatgattccaaatgtgattgtagctcaagtggagtggagacctcattgtttatctagtgaattcatatagcataaagatacaggagtatcagccaaggagtcatctgggggcaattgcataaaactctcttttctcattgcacaacatcacctggaacaagaactctaggcttttcaagatttaaaggtggctgaaaaattcagtgaaaatcaatgagaattgagatttttaataaatcacaaattcatta

SEQ ID NO: 109028 - DNA, 578 bp, Homo sapiens
gtattaatattattagttatacctctagtcctgagaatctgaagctgtaaactttcactgtggaaacatgcagaggcatacagacacagaattgtgcttacaggttgaggacccgttgaagtttgttcctggaaccagactaaggatcctatcataagtacccttgccccaccacacccaccctttttaaatataatcttgacacatatcataaaagttgaaactacatttcaaaatcatatttggctttagtgttagaataaccaatcccaacaatactaaaatactggacttgccattttcttttcatgcttcattttaaaaacatttaaaaagcttggatgtattgagtaaattttgctgttatcattttgtgggattacattctgtttaggataaattttaaatttctgttcctctgcttgttctgttgagtttgtctgataactgcttttgtagttacttttgtgaaccagtttacaaaggccaaagcatttctagatcttggtgaggagttggaggcttaaaattacatgctttaggccatcaccatagcaaactcactagtaaactgaggt

SEQ ID NO: 109029 - DNA, 270 bp, Homo sapiens
gacataggaactaatctgaaggatctcccaatggccaaagttggaaaaatgtaaggaacaaaataaatgaagtactgggttataacccttagagtacaataaaaaaccatgagtctatacaatttgaataaataattgaaaacagaaataaaaaggaaggacaactcttccttatggaaaattccaattaataaatgtataaggaataaggaaaaaattttaaggataaagaaaatgtcctatatatacataatgaaatactattcagcc

SEQ ID NO: 109030 - DNA, 218 bp, Homo sapiens
agctcttgctgacacaaatagaataaatcattgcacaccattgtagaggggagaagttagtaaaaaacaaaaaagtaataggttttaccaaaatggatattactccaaacgtccaatgataggcagactatagtgtgatttttcatggctggtaaaaataaacaaaattatttgcagatgaattctgtcagccaagcaatctggactaaaagcttagc

SEQ ID NO: 109031 - DNA, 515 bp, Homo sapiens
aagcttattgatataaatcatatataatatcctcattctattctttgtattgtgaaataagctctatataaggtcataaaacaaataaacatctcaaagaaagtcaggaaatgacctggactttttttgaatcaagccaggcacagtgggtcacacttgcaatcccagcactacgggaggctacgacaagcggatcgcttgagcccaggagttcaagaccagcctgggaaacatggcgagacctcatctctataaaaaattaaaaattagctgggcccagctactcacgaggctgaggagggagaattgcttgagcccaggagttcgaggctgcagtgagccctgattgcaccactgcattccagcctaggtgacagagcaagattctctcaaaaaaaaaaaaaaaaaatcacatcaaatttactcataactaagaaatcagcaagcttgagaaggccagttccatggaattagggttccttttgtgtatacatgaacatgtgtaaatttctgca

SEQ ID NO: 109032 - DNA, 477 bp, Homo sapiens
cagagtggtcatgtgaaaatgtaagtcaaaccatttcacgtcactattcaaaagcattcaactgctcaccatttccttccaatttaggtcggaggctcttataattgcctacaaggtccaagaccacttggcctcattgcctctctggcccaacctcttgtttctcctccctcacacactccactccagctacgatggcccccttgctatttctccaatacaacaggcatgctcccacctgccatgggcctgtatctggaatgttttatcccccatgcttggttccctcccttaattccttcaagtttttactcagtgtcaccttcttagtgaggcctaccctgaccaactcattgaaatttgaaccctagctcctctggcactcctgatctcccttactctgccctattttccccttatattaattaaaataaactttttattctggaataattctaggttcacagaaaggttgca

SEQ ID NO: 109033 - DNA, 446 bp, Homo sapiens
gtctcacaagtagctgggattacaggcgggtgccactacacccagctaatttttctatttttagtagagatggggtttcaccatgttggccaggttggtcttgaactcccgacctcaggtgatctgcccgccttggcctcccaaagtgttgggattacaggcgtgagccactgtgcccacccgaattatatttttcgaagcggagtcttgctttgttggccagggtggtctccaacctgggctcaagcaatccccctgccttggcttccctaagtgttgggattaccagcctgatctaccatgcccagctgattttatttgttgagcttgagataaaatttgggttcatgtgttatggaaaagctttctgataagattgagaattattactgttagaatatcttacaaatattttgtttgtttgttttttgagactgtcccctcac

SEQ ID NO: 109034 - DNA, 259 bp, Homo sapiens
cctaccagatgatttgtctaatctgaaaaattattttgagctaagatgttcctagctgctatctggaaaggatgacatttaattatatgtaatgtaaagaagcctttcagtgctttaactctaggagtggagtgctggttactgtttggctttagaagtgacgttaagaacctcctatctgttcttttttatttttattttattttattttttttagaggagaggtctcactatgtttcccaggcttgtctcaaactcc

SEQ ID NO: 109035 - DNA, 255 bp, Homo sapiens
gaggctgagggagaccaggcccaggccattgggccacgtcatgcgcagacaccacccctggcctggtaggagccagcatctggttcccagcagcagcttggaaacccagcgacagaaggggcaggaactgcaccctgagtctgcagaagaggctgctcttaatggtcctccatgctgggccctgagcccaggtggggcctggccagctcctcatcacagctgaccagccctgggagttccaactccaggagacct

SEQ ID NO: 109036 - DNA, 321 bp, Homo sapiens
atttctgatcctcctgacagccctgcagttggctttggatatggtaaacctaaggaaagtaaagctcagcgagctggggtggctcacccagtccaagggcagattgcagggactcctcttcaccacatcttgtccattcccttactcgtgagggtctcctgagcactggtagtgagcaggtgctggacatgccacagggaacacggcagatcctccgccgtcccgaagcacacatcatggtgctccccttgactttcaccaggatgactccgggtatgggccagttacctgaacatcctgggggggcccacgtcccttcta

SEQ ID NO: 109037 - DNA, 2612 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109038 - DNA, 2665 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaaaaaaaagagcggaagaaaagttttggcccatagtgagtcctttacaagtcgac

SEQ ID NO: 109039 - DNA, 1437 bp, Homo sapiens
ctactaaattcgcggccgcgtcgacttttttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109040 - DNA, 2392 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109041 - DNA, 2228 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109042 - DNA, 1413 bp, Homo sapiens
  misc_feature (8)..(8): n is a, c, g, or t
tcccaggnggtgacagagtggagccatggctagagggctgctgtgaggtttcagtgagataacggcaagagactcgcccaggaaaccgatcattataacccctggctctgtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109043 - DNA, 1250 bp, Homo sapiens
tggtgagagctgatctagaggatcccagcaacattggactggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109044 - DNA, 1993 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttgggttttttggggttttgggaaaaaaatttggaaaggggtcctctctattcaaaattaagtttgggtggggggcccaaaatttttttccttgatttcaaccccaattccccttattcgggggggggttaaagttcccaaacctgttgtcagggc

SEQ ID NO: 109045 - DNA, 940 bp, Homo sapiens
ctggtcccactacaaaactttatttttgattagggtaccattctgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109046 - DNA, 974 bp, Homo sapiens
ctcccaggctcaagcagtcctccggcctcagcctcccaagtagttgggactacaggcaggcaccaccacacctggccaatttttgtggagacgggtcttgctgtgttgtccaggctggtcttgaactcctgagctaaagccatctacctgcctccgcctcccggagtgctgggattacaggtgtgagctaccacacctagattttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaataaggaaataaacttgaaaattatttgtcatcataaaaatgaaacaaattaaaatatttattgccaggcaa

SEQ ID NO: 109047 - DNA, 1651 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
  misc_feature (1609)..(1609): n is a, c, g, or t
  misc_feature (1613)..(1613): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcttncagngacgtccctgatccggtaccgagctgatttatttgggg

SEQ ID NO: 109048 - DNA, 1783 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccctgggccccaagcacgggccgggcatagatttcctcttccacaagctgccgcttttctgggcaccttgaagcatcagggcgtgaaatcaaactagatgtgggcagggagagtgttgcttacctgccctgctggggcagggtttcctgaaactgggttaattctttatagaaatgtgaacactgaatttattttaaaaaataataataaaaatttaaaaaaagatggggggggagaggaaaaaagcgggg

SEQ ID NO: 109049 - DNA, 1186 bp, Homo sapiens
  misc_feature (8)..(8): n is a, c, g, or t
  misc_feature (318)..(318): n is a, c, g, or t
  misc_feature (336)..(336): n is a, c, g, or t
  misc_feature (346)..(346): n is a, c, g, or t
  misc_feature (355)..(355): n is a, c, g, or t
  misc_feature (361)..(361): n is a, c, g, or t
tcccaggnggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccanaaactccaccctcatctngtgattccancaatgcagncatcgncaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatgcctatctgaactgggccgagctcgat

SEQ ID NO: 109050 - DNA, 344 bp, Homo sapiens
ttgagtaatagttaaaaaaatggttttgacatctgtgttaatgacctttctaatacctgagactcaccattctttgaattctatttaatacagcaatccttttcacaccaattgagcattctgttaatttgttctctttattagacctcatttacaatgggaactgattgtttctgaatattgatctctgcatttttttcttttagccttcagcattactcttgttacccctagttttgcatatcatcttatctcttactttacaagaaataggatcatcacacataactcattcagcttacatttctttccttttccctaatacctaatcacttattagattt

SEQ ID NO: 109051 - DNA, 394 bp, Homo sapiens
ccctaaggaaataatgagaagttttggtaaacaagtgcgtgcaagagaatcaattatggtattaccgagtaacatggaaaactgtatatgagccctagttaattcaaagaaaagcaacaaagtagaagttaaggtgtcatttgactttaatgtaatgtgcgtatgtatatgagattggaccatgtagaattgcacctaattgactgctttttatctgcaaaatgataattttatatggacaacctaagatgtatacatagaaacagactgaaagattatccacctatagttttctgggcggaagaaatagaataacttttacccttttccgtatgttcattatttacaatgaacatattttaacctgcaatgagaaaaatgatgcagggttttt

SEQ ID NO: 109052 - DNA, 5555 bp, Homo sapiens
  misc_feature (3)..(5): n is a, c, g, or t
  misc_feature (7)..(8): n is a, c, g, or t
  misc_feature (12)..(12): n is a, c, g, or t
cgnnngnntggngttttattttacaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaaacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcagggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattggaaaaaaagtctg

SEQ ID NO: 109053 - DNA, 487 bp, Homo sapiens
attctccttccttgacagttgtcatttacgtgctgaagcatattgacttgaggaaaacgccttccttggagtttggcatgatgatcatttttgcttatctgccttatgggcttgcagaaggaatctcactctcagggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtaagtattttcctttttttttttaaatttaattacttatttgtagatcaataaacacatgttccggattcatttatgtaactgttaactgttcaaagtcaacagctacatagacactcttttgtttaaagtttcttttgttaaaaaaaaa

SEQ ID NO: 109054 - DNA, 5582 bp, Homo sapiens
ggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaaacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcagggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattggaaaaaaagtctg

SEQ ID NO: 109055 - DNA, 3724 bp, Homo sapiens
ggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaaacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcagggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactata

SEQ ID NO: 109056 - DNA, 2604 bp, Homo sapiens
ggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaaacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcagggcatcatggccatccttttctcaggcatcgtgatgtcccactacacgcaccataacctctccccagtcacccagatcctcatgcagcagaccctccgcaccgtggccttcttatgtgaaacatgtgtgtttgcatttcttggcctgtccatttttagttttcctcacaagtttgaaatttcctttgtcatctggtgcatagtgcttgtactatttggcagagcggtaaacattttccctctttcctacctcctgaatttcttccgggatcataaaatcacaccgaagatgatgttcatcatgtggtttagtggcctgcggggagccatcccctatgccctgagcctacacctggacctggagcccatggagaagcggcagctcatcggcaccaccaccatcgtcatcgtgctcttcaccatcctgctgctgggcggcagcaccatgcccctcattcgcctcatggacatcgaggacgccaaggcacaccgcaggaacaagaaggacgtcaacctcagcaagactgagaagatgggcaacactgtggagtcggagcacctgtcggagctcacggaggaggagtacgaggcccactacatcaggcggcaggaccttaagggcttcgtgtggctggacgccaagtacctgaaccccttcttcactcggaggctgacgcaggaggacctgcaccacgggcgcatccagatgaaaactctcaccaacaagtggtacgaggaggtacgccagggcccctccggctccgaggacgacgagcaggagctgctctgacgccaggtgccaaggcttcaggcaggcaggcccaggatgggcgtttgctgcgcacagacactcagcaggggcctcgcagagatgcgtgcatccagcagccccttcaagacataagagggcggggcgaggtactggctgcagagtcgccttagtccagaacctgacaggcctctggagccaggcgacttcttgggaaactgtcatctcccgactcctccctgagccagcctccgctcagtgtggctcctcagcccacagaggggagggagcatggggccaggtgccagtcatctgtgaagctagggcgcctacccccccacccggaggacccctgcggccccctgcctagaggagcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactata

SEQ ID NO: 109057 - DNA, 446 bp, Homo sapiens
tgggcggtgtatgataaatatatctaagcaaaagtctcccttccatcattggtcaaagtcaagtctccgtgctgacactagaaaaccaggccattcctaacaactcagtttagagtgggcctttcatactccacccacaaaacagcagataagtggggaaaaaatacgctaccttctgtaattaattcagctctagcgtgtagtattgctttctgttaaatatggcctttgactttaatgctttaatatgtggaccaagtgacacacattacagaatctccccttccctctgtctcttacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaa

SEQ ID NO: 109058 - DNA, 385 bp, Homo sapiens
cacagcagctgtcctgcagtttccaagacacgagcatcaggcttgctaagtcctcccgcacccgcatctggggctctgtagctggggcaggccatctcatttgatctgccaatgttggaatggaggtgagtctgtggtcccatctctgccacctgctctttacaccccaaagcctcacagggtgagcacacactcttcagcagggccattagaatagtcagctggtcgtggtgctgggccggctggatttccagggaagccagcccatgaagctgctgcctcttcactgtgtcctctcacactgtttgctgtcacccaggcctgcggggagccatcccctatgccctgagcctacacctggacctggagcccatggagaagcggc

SEQ ID NO: 109059 - DNA, 4440 bp, Homo sapiens
ggacggcaatctccgcttttgtagtaggtggaggaatttattttctgggtcaggctgatgtaatctctaaactcaacatgacagacagttttgcgtttggctccctaatatctgctgtcgatccagtggccactattgccattttcaatgcacttcatgtggaccccgtgctcaacatgctggtctttggagaaagtattctcaacgatgcagtctccattgttctgaccaaacagctgaaggtttaacaagaaaaaatatgtcagatgtcagtgggtggcaaacatttttacaagcccttgactacttcctcaaaatgttctttggctctgcagcgctcggcactctcactggcttaatttctgcattagtgctgaagcatattgacttgaggaaaacgccttccttggagtttggcatgatgatcatttttgcttatctgccttatgggcttgcagaaggaatctcactctcaggcaccatctacagttgtgccattccccagccactgccttcatgctgcccccgccggactggcagagccaggggtcagccacctgcctttgagtcatcaagatgcctctgcagccacaattctgacctaagtggcagggcccagaaatcctgaaaacctcccgctgccttttgtgatacttcctgtgctccctcagagagaaacggagtgaccttttgtcctttacctgattggcacttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattggaaaaaaagtctg

SEQ ID NO: 109060 - DNA, 4030 bp, Homo sapiens
gtccatcgccgcgaaaggggaagtcaggcttgcccatggagacgggctgcacagcgctggaaagctggttgatcagcctgctcagtctgaagacggagattcacaggcatctgcccagcctgagatctgggcatacagggtgctctcagctttcctgctcggatctagcaccagatgtctcctgcccagtccagccaacatttcgtttcttgtactgcgtcactctctgtcttcgtccagcacctggtatgagcacagtcaggaatcggtggatgagcgatgacttcccactcctgggcaccttcgcagtctatctccctgggtagcagacggctgctgcccttctctgggcatgttctgaatgtttacactggtaccttctggtatcttctttagagccccctgcaagctgcaactctaggcttttatcttgcggggtcagagcgccctctagagggaaaagctagaggcacagggtttctgccggcccacaactgctgtcttgatttgcattttacagcaaagtgctgagagcctctagtcgcctcctgccatctgatctccctccccaccattcccgtactcagttgttcttttgtctaatcggaggccactgtgctgaggccctgcagtgtctgctcactgctgccatcttcgctgctagtcagggttccatcctctttcccctctcccagttccctaccacgttggatcccattcgtcacccatgctagggtccccaaagcactggggcaggggccagagcagcagcacccagtgctccctcctctactctgacctggggccccagcatcctggagcacacgctccacgcacacacaccccagccctgtcccaggggcctggccccctcagccatctcagggtgaggagctgccagtcatgtccagatggaatgactcccatcctctcctcatctcccctttgacgagcctcaaactgctcagctcatcaaagagccattgccaacttccgtatgtggttctgggtcccagggagccttggaacctggcaccctggggtggtttaattcatcattaagaagcattcctgcttctcaagggacacagtggcctgcatgggccagcatggaccctgggctgatcatgtgcattcctgcttctctggggacacagtgggcccacatgggccagcatggaccctgggctagagcaagcacatctccatctcttccacctcaggcagtgtggctccagatgtcaggagggactgacctcaggaccttccaggttcctctgtgccaggaatgagaggccaggcccgatcctaccacctcgccttgaccctgaagtcagagcaggccagccaagcaggaagcacactgtttactttttgcatgaaaagtaaatgtgtacttgatagagctaaaatatgatcttttttaatttctcaaccccataatttgagccattgccttgcttaattttggtttccaccatttccttttagtggagaagagaggaagtcagagggtagggacctttgcctgcccctgggcgagtgcgggcagggatctgagaccagattgttctcgcacccctgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggtcacacctggcctcacactttgagctgagacttgaaaacgatgctgtggcggaagagcatgtggggcttggtggaggggccccaggatttgttgggggcaaagggggtggcgggaccgttcccaggaggtaccagcacctgcctcgatctcctctgagcctcttctgccccctgtcggccaggtgaggtcagcagcctgggagagtgcccccaagagatgagggcaccccgtgttccttggcaatcttggctcaccttggtaacaaaaggccatagaagtctgtttttctgggtcagttttttttgcctgagaataacaaattgctgctgtctacctttagcacacccaataattctatttggggcagtgaatgcatagaagatataaaaatacgcagcttaactatatcttcctgcgtgtgtatttattttcttctgggtctaggccatggtacaggagaactgtggcgtgtaggaggaatacttcaggatgagtgaaggctggagccagggagcgctggaggaaaccagccctttagccagcagcccctccaccacaggcactgctgtgtggaacgagttcttggaatgaatcccatgctttctgcagcctgtagttgttatgacccctcggaacaaccaccccgtggcttgtgtggggtctcgcagggaaaagggctggcttctaggtccccgagataagtgtgcagggggatgggccagggccaggctaagggtggctcagttccatcatctggaggtcagacacactgtccagaggcagaactgaagccctctcggcccctaccctaagccagccacccctcttcacagtgggtgagctgggctgggctggctggcatgaggccaaggggtaggcctgagcgccagagtcgcccaggttagcccacaggattcctttgtgtgccatggaatgctgaaagatgggtgactggggacccttcttaaaacctttggcaaaggtgccatcggcagggcttggcctcatgaagtctcaggtccgtgttcccgcagggcgcacatgcttggagagtcctcagcagggtagccgaggccaggccacttctgctgaggatggggcaggctggggtgtgggtgtggcctggggtggctcagggctggaactgctgcctgattcctgtgtggggagaagctcagtggccgtttgctgccactgacaaggatttcacatgcagaagagaaaaggcccccctccaccccccgcattccctgccgagtgagagccagtgtttgctgcccttgctgggggcgggtaggaaaccctgagcttcctgatgcggagtcatgaagcagagtcctcgggaaggcatctccacagccccgggtcctctgtctaacgccctccatttcacgccctccatctcacagtcaagataaaggcctcgagaataaagagccagcccccttccatttagtctcctgccgtttcccaaacagttgtccaacagttagacattgaggggcttcactgttaccaggcatgtaacagaaggaggaagactaacacacaccccctgccccatcccatccccctctcccgagctattttcttgctgtggcctctggtgcccttgagttggtctccccggctgctctgcgggggcttcactggcttcggagtgagcgcgaagtgctggtgagcagtgggcctgtgattggatgggaagatgtgcatccgtggtcaaaagtcagctgccagccctgcggaaccagagcctcaggctgggatggggaggcctccctgcttccacctgcatggtgggcatggcctggcttacaccaaaggctttgacggtttctccaagtaaggatctgcaaatcttgaatcgtcctcaaaatgacgaagcttgaattgtcctcaagatggatgtgaatcttacattccttttcatcatttcctttgtaaaaatgacgagtgctgggtttttgttttaagaagcattatgaaggccagacttactcatttttctcccccaagtgagctgcaagaggcccctgttaggcccctgtttcctgagcagtgatgtgctgctcttcttggtggggctttgggctgggaggggaaggcgggtcagagatgggggacctgtggctgccatgcaggagcccctgcgtcatctcgttggactctttaagggagtcaggaatagatgtatgaacagtcgtgtcactggatgcctatttagaaataaagtgtatgctgctgaattggaaaaaaagtctg

SEQ ID NO: 109061 - DNA, 675 bp, Homo sapiens
tttgacttaaagttacagtttccaagaacctatggatgacatcaaatgaggatgtactgtattaagtactattgtatatagtagattatggcattgtagcattatagtatattattgcagtcttaacagttgggagtataatgtgttttagttccctgccagcccacagaattattcagatgaaccaataaaattttgttttgaaattcaaggcacatctcactttcttttttttttttttctcctaaaagactctcgctctgtttcccaggctggagtgcagtggcatgattatagctcactgcaacctccacctcctgggctcaagcgattctctcacttcagcctctcgaatagctgggatgacgggtgtgcaccaccatgcctaattttttttttaaattttttgtagacatggggtttcaccatgttgtcagagctaatctcgaactcctgggctcaagcgatcctcccacctcaacctcccaaagtgttgggattacaggtgtgagccaccacaccaagcgtatctcaccttcttgatactacaaaaccttcctcagtcccctgtttgttctctttgctcccaagtgcaatccctgtgtgggcctgcatagcttacactactttcctcttcttgtctgagggaatgtgtaactaataaactgttgttga

SEQ ID NO: 109062 - DNA, 217 bp, Homo sapiens
tagacttttttccactacagattaattttaccggttccagaaattcatataaatagaatcataccatgtttctgttgttcccagttcttttcactcaggaaacacaactgtatatatcagtagttcattattttttattgatgagtggtatttgttgtttaaatataccacaatttctttaatctccagggttatttcagtttgggattattttgaa

SEQ ID NO: 109063 - DNA, 390 bp, Homo sapiens
ttgaattaccggacacccacttcagtggcatttattcggtgaagtgtttggggtgtagggaaggggtggtggtgactggaagtgtagcttggggatcgcctttttaatatccctgtctagtcacaaaaataaggcatgttctaatcaactaagcacttgaccatgaacttctcgtaagcaaggtgagtggtagattttttttcctcaaggatgcaagcagctgatagaattgggaagaaagttattagttgcaaaaacatttaagctttgcagtaagattactagtgcaccaaaggaatcgtgactgttaagccctctagctgattaactggtgctgttattttattttaaaatgttgtaattttttcacaacaagaaaagtaatgtgta

SEQ ID NO: 109064 - DNA, 482 bp, Homo sapiens
ctccctgcatgtgaggagatgaagaactactcttcttcctcccattgttaacaaaatctattacgcctttcatctagaggcaggaatccacctccacttttacaaaatgaatccaaccactaaaaccacagggtagaagaggcatttttcagtccagatatagttgtgtttcttcagtaaatcaaaaggcacaatcttggtaatgctgtaatatcctattttaaaatctgtattcaaaataggggtgggggaatgtggggggagaaaaggaaactggtaaatgggtcacttcttggcaaacttagtaaaaaccaagactccctgagctgataacttatgtttttatgagatccaaagatagaaaagaacaacctattttcttaaattctaccaggctgggctctacctaacctggtaagaacacaacccactatagttaaagaaaggaggatgctttctgaagcatctcctgtgtgccagtc

SEQ ID NO: 109065 - DNA, 746 bp, Homo sapiens
gcatctttgaacaaataatcttaaaattcagactttcagggcatagaaagatgttttacaatctggtggaatgattacagctgcagtgttggctgctttggcaattacagcagtggaagactgcatatttacattttcactattcagggaaaatttttatcttgctatcattagtatacaagtgttaatttatgcaatgggaatagttaaggagcattttctatattcttagcataaaacacttttcagggtggttcattaaaaaatgtataagatgagattcccagctttttggctgagattaagtacaaaaatgtataacttgcttttggcacttggatgcttataggaattcactttataaataattagtgtcaaaaacctagttttatttcagagcataaattcaatttttgattcttttctgaatttttatttttttactatttgcttttttattacagctttcataatagttgttttgagtactttcaaaacaagaattcagattttaaaatttaatttttgtttttgtccatgtaatatacatacatggtttcaaaagacaaatagtacttcaaggcttaaaataaaacccatctttgtccatggttttatttcttattggctgccattttcaacccatttggctgtttctcttgatatatatacatacaatttttttttaagatgggatctcactatgttgcctaggctggtctcaaattcctgggcttaagtgatcc

SEQ ID NO: 109066 - DNA, 412 bp, Homo sapiens
tacatggccttcctagggggtactgggctggacaccacatctcctgctccagtgtcctctttgtaccttccagaggattgtctgtgacctagatttctggggatcgcatccctagaatgctcacgtggtcagcccatggctggcctttgtggataaacctgtgagctttgctatagatgtgcctgatcctagctagattttctcatccagtgttcttagaacccaagaaagaccctaagggttggagtagtgtatctactctcaaattagaatgcagggggtggtggtggtccagagccatccttgcctatagacaggaaggattatgacagtgatttctgcataaggtgcctcttcctttgactagtgctttttattatctctgcctgatagaaagtcccctctttttctt

SEQ ID NO: 109067 - DNA, 411 bp, Homo sapiens
gggattacagattgacttgatgcacaacatcacaaaggcgatttttgagagctgatagtgcatcagccgacccaggtaatttaaaatattcttcatccagagatagaggtggttcttcctcttacggactgcaaccttcaaattcagctgtggtgtctcggcaaaggcacgatgataccagagtccacgctgacatacagaatgacgaaaaggagagatcgatgtcttattgtgatgagtctcgactgtcatatcttcttcggaggatcacccgggaaaacgaccgagaccgaagattggctactgtaaagcagttgaaagaatttattcagcaaccagaaaataagctggtactagttaaacaattggatatcttggctgctgtacatgatgtgcttaatgaaaggtaag

SEQ ID NO: 109068 - DNA, 376 bp, Homo sapiens
cacagtggccaaggaggctaaggaagaagcacgtggacattccattcccattatggccaacccccatgggaggcagctctatcatttctgggagccgtttcctgaacccaaggctggaggaggtggccttggtttcctaatctgtcagaagagatgacaatgctatcttggcctacttctgtggacacagctggcagtgctcccacagctgggcccaaagcatcagaaattcagggacaagagagtgtgtctaaggtagaagccaggccagctcctccattcggggttgggaaactgaggcccagggagaggcatgagggtgtggggagggaaggctgaagccccatcccagccagcctctaccctcgaagctgca

SEQ ID NO: 109069 - DNA, 457 bp, Homo sapiens
ttttactacagagtattatgataggtaatgtatacaatcgaacacactaaaatgggacccattctagaggttttagtctgtggcagcgtttctcagcctcaccactattgatattttgggctgagagattctcctttgtgaggatgtgtcttgttaattgcaggatgtttagcagcatccctggcctctactcaccagatgctagtaggatctttccaattgagccaatcaaaatttttgttagaaaattgctgcaagtcccctatgtggcaaatcacaactagtggtaaatgcagatatatttagttagatacaaagatcaaatagatcattgagcaaagactgaagaaaaaatatgaaaaattattttgtttatacataggtaaaggaaagagtgcagttagtgtgagtggcaggatttgctcccttagagaaaattttgtcagaggaaaaagtg

SEQ ID NO: 109070 - DNA, 670 bp, Homo sapiens
ggcatgatctcggctcactgcaacctctgcctcctgtgttcacgcgattcttccacttcagcctcccgagtaactgggattacaggcgtgcaccaccacgcctggctaatttttgtattttttggtagagatggggtttcaccatatttattggtcaggctggtctcaaactcccgacctctggtgatccacctgccttggcctcccaacgtgctgggattacaggtttgagccaccatgcctggccgagtggcgtcttttcttttccatagctctattatgggcaatgtacctttggttgggcatagggctattttttcccctctcatgcttaaactgaatcaggtcatagtttatgataagagacagggaagaactggcttaaatcgagagtcaacaaacttgttttgaatgggccaaagagtaaataatttaggcttgatggactacacagtctctgtccccactgctcagctctgctgtggtgtccaaacagccaggggtgatgcagaaacaaatgggcatggccgtcctccaataaaacctcattcatggaccctcaaattttagttttatatactttccatgtgtcacatgtcaagaaattatatccttcttttaatttttaaaactatttaggccaggcgcagtggctcacacctgtaactcc

SEQ ID NO: 109071 - DNA, 781 bp, Homo sapiens
tacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaattt

SEQ ID NO: 109072 - DNA, 170 bp, Homo sapiens
tctcctattcaatccatcaactagtctaggtgactacttccaaatccatcccaaatgcatctctttctatctgaagccaccacctcaatctatgacttggatacctatcaagcctcccacttttgcccttcctgcctccagtcagttctccccactatggccagagggag

SEQ ID NO: 109073 - DNA, 473 bp, Homo sapiens
tcaccaaagctggaagtcttgttttggtgtagtctctctgcacttacaaaatcacaaaacccagtggattttactttataattttccctcttttcttcctccttcttaggtcctcatatcatctcttattggattattacactagcaagtctgaccatggcacaatattatcttcaaaatatagacaataaatgatctacctttattaaaattatttttattgttggccaggcgcagtggttaacacctgtaatccctgcactttgggaagccaaggcaggtgggtcacctgaaggagatcaagaccagcctggccaacatggtgaaaccccgtgtctattgaaaataaaaaatcagctgggtatggtggcacgcgcctgtaatcccaggtactcgagaggctgaggcacgagaatcacttgaacccaggaggcggaggttgcagtgagccgagatcacgcctgggcaacaaa

SEQ ID NO: 109074 - DNA, 772 bp, Homo sapiens
tcagttttcttatctctaaaataaggacaaaattggaaggaaaaaccctcacaaggttgtcaaaaaaatataaatgatgtaatgcatataaaataatcagcccaggagtacaggcctgttaaatggcggttgttaagattactcttgttaataaaaaattccaagtcaaaaatcctgccttgggatctgactactgtttctctctgtagaatttcctatggaaatattaacatatattcataactcagtcaacacatgtttactgaactccagctacataccagactttgtgttaggtactcaggacacaaaagtgagttaggaaatagccctgcctttgtggagacgtgctagaagtatgaaaataggcaaaggtggcaccgttcgccagttttactggaaagtgggaggcctcagtgcgggggtcactcttggtttggatgatgttagatgaagagattctcatagttctcaggattaggaggttacccagaacagagaatggcatgaactaaaatacagtgggtttaggaaatacaagtggacagagggcgagagcctaatctgaacctccaccctgccaccaaacagcagaacatcgctggtgctcaaaccagtgcccccagacgggggtccctgagttcaggtttagcctggcagtgggccaaggatccctgaggaagcagatcccttttacggtgctttggcttgggatgaccctacatattattgtctgggagacctcacttgtgtggattgctcacagccttct

SEQ ID NO: 109075 - DNA, 271 bp, Homo sapiens
gctccctagacaatatacaaccatccaggagtcatccacaattccaaacaaaggattatttgctcaggagcaaaccaaggggccataattccacatctacaaggggcttatggggagtaatttaggtgtaatggggaatagaaattagccgggtgtgatggcatgtgcctgtagttccagctattggggaggctgaggcaggataatcgcttgaacccaggaggtggaggttgcagtgagccgagattgcaccactgcactccagcttggg

SEQ ID NO: 109076 - DNA, 504 bp, Homo sapiens
catgccccacccaagaccaatgaatctaaatctttgaatcagccattagtattttttttaaaacctccccatgtaattctaatgtatagccagtattgaaaacaactgatgtgaagctgtgttaaagttctgaattgaataaatttgtgtagttctgtttatttgttatacttgttaactacacttttggaagaaatcggatagtaaagaaaatgagatttttatataaatgtgtaacaaagcagaagggcccaatgagaggtcttacttaagggggtttatacaagggaggtattatttctgactgtggggtgttaaggaaggcttctaaggagttggtaacatttgaactggatcttgaaggctagaataggcagatatgaaaagaaaataagtttcaagcataggtcaagtcctattgaagatgattgtgggggaaacagtcagtggacataatgtgaagacataaaagggaaataaggtgaataggtaagttggggccac

SEQ ID NO: 109077 - DNA, 473 bp, Homo sapiens
attctcaaatatgaatatgctagctggaattgccaaaaaatttttggaaatgatgcataatagaggagatttacatttccagatataaaatgtactcaaatgatgctaattaagaccacgtggttattattgcaggaacatgccagtaagtggaacagaatagtctagaaacagagcctaatgtgaaagagggtttagtacatgatggagggaaaggatgaattatttaatatattctaagttaactatttggaaaaaatgggattagagcctttcctcaccctatataccaaaataaattttgatttgatgcaaaaattttaataataaaaaatgaaaagtaggaaaaattgtggttaactctgacattagggaagtcaacagaaacaaaatatcactggaggaaaatgactcatttctccatacagaattaatatatatatagttttttgagacagaatctcactctgtca

SEQ ID NO: 109078 - DNA, 282 bp, Homo sapiens
tgctgggattacaggtgtgagtcactgtgccctgctggatgcgtcttttctgagactgttcagtttcttcagagaagaatctcccaattttctacctggggagtacaagcatggctgctcattttccagaagcagagttggaaaagggaggtggagttccacttctcagtgtgtagttttttttcccatttcccagatttcagtcctactatttctgagcccagaaccttctatattccttataagatgggaggacaggtggacctgggactccaactacat

SEQ ID NO: 109079 - DNA, 444 bp, Homo sapiens
tattcagagatgacctaagtaaatatactgtgtcaatgtattgataggcccagtagtgctaaaatgtcagttcttatgaaaatgatctacacagatgaatacaatttcaatcaaaatcacagctatattttttgtaaagattgacaaactgattctagaacgtaatggaaaagcaagggattacagaagccaaaattattctgaaaaagaacaaacatggaagactcatgacctgatttcaagacttaatgtgaagcttcagtaaccaagactgtggtactgacaaaggacagacacacagatcaatggaacaagatagtccagagattagatttctgcaaatatgatttgttaatttttttgacattcaaaggaaattgagtggagaaaggatagtctaacagatggtgctggaacaattgaacctccatattcaaagaaaaa

SEQ ID NO: 109080 - DNA, 229 bp, Homo sapiens
gaccctcttcctgccctgatctgtggcccaagaagttgacctctgcgacctgcattcccttggacccttatcttccggttgggttcaaccaatgacaggcacactggctgcttcctggccatgggctagcaggggtcatgtgcctctagtgaaggtcatcacctctgttgggcaggtctcccgtgctgctaaagctactgctctcccaggttctattaactgccccctg

SEQ ID NO: 109081 - DNA, 697 bp, Homo sapiens
gaggttgcggtgagctgagaccacaccattgcactccagcctgggctacaagagggaaacttcgtctccaaaaaaaaaaaaaaaaagaatgacttagattcattctctctgtctgttattttgtatctgcccacattgatgttaatctgtcactttccttcctacgtgcatgggcttgtgaaatctcctgaccatttatgctatttgtttgtctttttgcaaatcaaaagagcctaatgtcaccttaaagcatcatggtaattaaacttaagaaaggatgagtgattacagtttatttaattcctccctctttagagaacttctagagtacacaggcatagacatacaaatttagtttcaagtaagaatgagagtatacctgagtagtttacataaaattatggggaaaactggatatgtgttggagcagacaatgtttgtggggctaggtgtccagagtcaagtctgtctcggatgggccttcagcagaacggctttttcctgacataggtgcagcctcatcctatgcgtgctcatcacaagagcatgtttctcctttgttctgggggatgggaatttccttcctttgattcctttctcttcactcctacagccccagtgtttgcttgttcactccccgcgtcccacatcaatgccagtcaactccagcctgggctacaagagggcatcgagatct

SEQ ID NO: 109082 - DNA, 418 bp, Homo sapiens
ggtcaccatattgatgccaaactcagtgtggtacccaatgggcattttgcagcccacaactcctgggctcaagtgataaataagtgagaagaaaggaaacacatacctcagagagaaacacagcaaatatatcaaaattcacaaaattataaaatattagtaaaagagttgaaacctagcatatcagtcatatcaattgatgtaaatggactcacctcacctattaaaagaaaaagattcaatttgctcataaagcaagatccagctatgtactgtaagaaagacatacatctaaataaaatgattcagaaagggtaaaaataaaggaatggggaaagatattcaggcaaatgaaaataataagaaaccaatagtaaccatactaattacagaattcaagcccaaaagcataaaatcc

SEQ ID NO: 109083 - DNA, 565 bp, Homo sapiens
cctaggatagggaacttctgaatttaaatttatacacttggccttttagggagtggaatctttaagttttagatatttaaattgaccccctgtacctgaaaataaatacttggtcaagccatttttaatgtgagatgtctcttaagttttctctgaaatctcatgtcttgtccaagtgccgtatgccacccacccgttagtactttggaacaactcttttctgggctttggccacaacttcgtgacccatttccttgtctctagtcacaccacttccctgttctaaattcttcaatggctcttcatcacttatggaaaaagtgcattgtataaaaaatgtgtatgtgtaggtatatgcagactcggcataccagggaggctatgataagacatttgcctgcttgttcagtctcgtcatctagcaatcatctctgtgaatctgttacttaagtgccctaatacatatattgtaccctcgcttagcttaggctgtggcaatgtatatatatttttttctgtgaaaaaaacatattgtttcctttacctctctgcaactaaaatcctg

SEQ ID NO: 109084 - DNA, 358 bp, Homo sapiens
ccgccacctgccaaactcactaaatcaaaacaggcaaatattcttaaatgcaccattatttacttttacaagtcttcgagtaaatcccagtaaaactaaacccagctgttaactgtctcttaggacaaaaggttgtacccaacatgtttatccatattgatccactattgatttttgttgtgttgaatgacatcagtagtgtctcgttaaggcaaaattaagaccataaacaggtgttcagtggggtaggcctcattttccaattggatttttatctattcacaatagataaaagttcataattgcttcatctgtgttcatggctgtcattacagctttataaactccaatactgcag

SEQ ID NO: 109085 - DNA, 465 bp, Homo sapiens
acagacacctcctgctctcctacagcccacgctcagcagggacagagaatgagaatcactgaaagaggacatcagaaagggagtgctaggggaaggaagaggacaaagtaggggcctcacaagatgggagccaggagaggagggaggacgagagtagactcagagaaggaggatccaaacagagggcccagccagggcaggaggcggcgaggccacagggtcagggtggcaagggcctgcaggtcatggaagggataacgaaggcaacaggaacgcggcatggcagcaacactgcagacacgggggtgctcgtgaatatgtgtgggtgggtttgttttcttggggacagtggctgtgacacccacatcagcgtgggcacaattctgtgtctctgagtattcccacccactcccactgggaaggaagcatcagaggcgagagcaggacacaccaagatgccccgtc

SEQ ID NO: 109086 - DNA, 483 bp, Homo sapiens
ttttttctgtttctgctaagatccaggcctggacaataagacattaagtttagcattatccagggctggagagagaaggacatgatagaatctatcccttcagatctccttgaagtgagagcgagagaaagagagagaaaggaaatcaagcagagaaccatatgtaccctgccattcctccatgtggtgaagtcagggatgtgagaaggcacagcagacattgaaacagaaagctcaaaacaaaggaactgtctcccatttccatgtggaaccccagggtgctgctcagtcagctatgagtgacacaaggagccaaaggagcttgtgggtgtagataccagaggtcaaagagtgacactcaagacccccagtgagaagtgtgaacacaccccccaggaagcctgtgggaatgcatcacacttcaccagatacaagccatggatcagccacagaagaagagagacaagatctgatgcccattcc

SEQ ID NO: 109087 - DNA, 216 bp, Homo sapiens
caggcgtgagccactgcacctggactccgttgtgggatttaggaagtggggccaaggaatagtaacgcaggtgggcatacctcatgcttccctgtaggtggcacagagtgctatgcccaccaaaggcacatgacccagacccctgtccttgggatctgccctcactgcatccactgcacccaactaagcgctcttcatccaggctggacacaaggt

SEQ ID NO: 109088 - DNA, 376 bp, Homo sapiens
agtcatgatgtcgattgccgattcttcatacatcttccatccattatgtattttagtacccttcctgtatacagtggatctctgtatagagagcatgttcttgcagtttgcctccttcaaagttgagtgcaaactattggacttgactttatgattttcacccaatgtttcgtccaggcaccaagatacacttttactgttcctgatccattttagctgagcattttgatatatttttaaatcatgtctttcaaaatggtattattataaagaatatttttttttataggctcaaccatcaactcttatagttggatggaaatgattccaagagaggttcattatttcctcaggtcatgtggctgttggccacaga

SEQ ID NO: 109089 - DNA, 702 bp, Homo sapiens
ggatggagtaaagataatataaaggcaatgtgaaagggtcttttacttttctgtgggaaagtgggaactagtgttcctaaacatgttttgagacctctgaaactcaccttattcccctaaagaaagccataaaaatggtaatacctgttggtgtaaaactagtgaattcaaagtaacactttcctgatgtttctagcaagccccagagacaagttagcagtgttgaagccccatagtatgcctttctttctggcctgcagttttccagcagatctgatgatagtccaaaaatgccatactcttagggagatagggtgattcatttttttgtgctcctttggctttgatgcattatggtccaagtacagaagagatgggttgtgatatttgctgcttttaattatagggaataccttgccctgttgggagtgagttggaaaccacgtattaaagtaaaacctcacactggacttaaaacagtatctcagggaaaattgcttgttgcttcagctgattcttttaaccttccacagggtatcctgagaccacagcacttaatttggtggaatgagttgtgctaatgagaactcagacagattaagtgacgttgtcatttgcttctttccttcaaaaatgaaatcagctgcgattttgatatataatgactgcttattaggtgaataaaatattttaatggtgtgt

SEQ ID NO: 109090 - DNA, 474 bp, Homo sapiens
atttacatgaaaagttagctcaaacacagtctctattagcaaccagaagaccagttagtttaggaaatcatctattacaaagaaagagttaacatgttaaaatttaaggcaactttgttatgttagtctaagtgaagacttagctctgcctctatctgaagtatcaaacaaagtttcagagagccataaaataatatgcatcaattcatcatcatctgctgagtcaaacattggaaaataatgtcaagaagttaccctgtaattacttcgtggctccttgaaaacccatttgacataatcactctttgacagctgcaagagggaaaatgttctatttcttctcccaccagtattctcttctgagacccaggggcattgcttttcagcacttcctgatctgccaaatgtttatgaaggaagtatgtggggtgccttcgtaatcagtgctcccaaggctggtcaggggttgagagt

SEQ ID NO: 109091 - DNA, 506 bp, Homo sapiens
atgcaggctaatgagggtcgttgataggaaagtattgcttttcctagaaagctctggttctttgacagaagccttctggtggccacagttcctgagccctaagaagaaatcctgtagggtacctctaggacatgatggttagtgtagggtcatgagtctgctctctggtcatgtcaagaaagctgccccctactttgtgtttaagcagatcctggaggctgcaggatagcccattgagactaagtggagaccaggcatcaggtgaggaagccttagcttggagggtcagaggcctcagctagacttggtaaatatttggcacttcctctccctcacaggaccacagcaaatgttaaataatcacagcactctttagtttgaccaccactaatcgattgagttgggcaaatagcatggaaggtctttgcctattctttgggagctctgggtgtccccagagaattgagtctggcattaagttttgcctctcctttctcgttttcttt

SEQ ID NO: 109092 - DNA, 2864 bp, Homo sapiens
ccaagtttattcctcctaattatcacacacctccttatctcactgctgagccagaggtaacttaccaccgattaaggccacaggataagtttctggtgttggctactgatgggttgtgggggactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcagcatgaagttgacattgtggaaatgaaagtaattgggtattagaaatctgaaagtactgtcatctaaaagcaattgtgattttattgtaattggttgtcactgttgtacggtgtctagaattaaagaatacatgtaaactttcatggtatttagcctttcttaaatttttttaaaatttaaactttctaacctatgtattcaacttctgtatttatatttaatcagtggttcatgttatataatacacccttaactagttaaatggaatgttggtatggtacagagtaccatattgctaagaaaactgtcttataaaagatgtatatgtgtgaagacatgaaagtttaatgtacagaatggttggagaaatgcctatggtgaattaaagcttcatatctgctttctgaa

SEQ ID NO: 109093 - DNA, 2972 bp, Homo sapiens
ccaagtttattcctcctaattatcacacacctccttatctcactgctgagccagaggtaacttaccaccgattaaggccacaggataagtttctggtgttggctactgatgggttgtgggggactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcagcatgaagttgacattgtggaaatgaaagtaattgggtattagaaatctgaaagtactgtcatctaaaagcaattgtgattttattgtaattggttgtcactgttgtacggtgtctagaattaaagaatacatgtaaactttcatggtatttagcctttcttaaatttttttaaaatttaaactttctaacctatgtattcaacttctgtatttatatttaatcagtggttcatgttatataatacacccttaactagttaaatggaatgttggtatggtacagagtaccatattgctaagaaaactgtcttataaaagatgtatatgtgtgaagacatgaaagtttaatgtacagaatggttggagaaatgcctatggtgaattaaagcttcatatctgctttctgaaacaccaccaccaccacacccaccaccccctcctccccgcctccccccccaaaaaccttcttcaccaccctcctacccccgcgcccccacacccaactaacacctgtct

SEQ ID NO: 109094 - DNA, 389 bp, Homo sapiens
ctagtgggcaggtgtgcaaagccccaggctgggcccagagaaattcagcagcaggtttcagggcagcaggaggtcggctgggagggtggatccttatgcatctctctgtctcatcccctctgaccgcctcagccagggggagagaatggagctcggtgagcagccccagtgggcctgctatgaattacaggaccccctgcaaattcacacacatgcttgccccctgctgtgctactgacagcaaaggcagaatctgagctgctgggacttgcccaaggctgccagctgcagatgctggagccagacagaagcccaggccgccttcacagtctgcatagttccagtgcaacaaggaacctaaagggttaaccagcattagcacagggccc

SEQ ID NO: 109095 - DNA, 273 bp, Homo sapiens
ttataaagaaagttctcaagtactctggcagtaaatataatgcatgttgttatccatctttagtcacctctgcctggagagtacagttgtccctcagtatacctggggtattggttccaggatgtctcctccacctggcagataccaaaatcctagaatgctcagtcaagtcccttatacaaaatgctgtagtatttacactgtatttttaattgttgtattttttttattgcctccccctcccctgcaatattttctttttgtttttttttt

SEQ ID NO: 109096 - DNA, 103 bp, Homo sapiens
aagagaagtaactttgaaaacatcatgactttgagctgaaactaagaaaagcaaaggggtttcccctctgcacctaatcccttttaaggggggctcccaggag

SEQ ID NO: 109097 - DNA, 474 bp, Homo sapiens
atagctggtcttagggagatgagaacacatgtagagtctgactttatgaagtcattgacattaacacgtatgataactctcaattgtgaaagttaattctgtcagaaatgctgtgtgacaggcctattagagcggctacttgggccatttattgtactgtggcctatttccgacaagtcagataaaccatggtttgaatctccactcagtcaaaactgcagctagtcacttaaccacactggtgttcaatttactgtctgtgtagtgaattgaacatacctacctcaatgcgtttttatgggaataaaacaagagtacaaacctatctgtccactagtggtattttttaccttaagtcacattccttcaccactaatagtggttaagttttctgactctcagtgatccattttcaaaaggccatctctgaaatttttgcctctactttctttaatggcatttccctatgtcact

SEQ ID NO: 109098 - DNA, 453 bp, Homo sapiens
tttacttaattgtagtcagcttgaaattacatttgtttaactgcaccaaggacccaagagagaactgtaaaatctttacctttctaataactttcatctcattcctctcatctgttctccaaacttgcttacatggccttgttctcatctggtctgaaaaaccttaaccaggccgggcgcagtggctcactcctgtggtcccaccactttgggaggccaaggtgggtggatcacctgaggttgggagttcgagaccagcctgaccggcatggagaaaccccgtctctactaaaaatacaaaattagccaggtgtggtggtgcttgcctgtaatcccaactacttgggaagttgaggcaggagaatcgcttgaactcaggaggcggaggtggcagtgagccgagattgcgccattgcgctccagcctgggtgacagagcgaaaaactctgtttc

SEQ ID NO: 109099 - DNA, 397 bp, Homo sapiens
gcggccgctactactactactaaatttgcggccgatcgactctcattcctctcatctgttctccaaacttgcttacatggccttgttctcatctggtctgaaaaaccttaaccaggccgggcgcagtggctcactcctgtggtcccaccactttgggaggccaaggtgggtggatcacctgaggttgggagttcgagaccagcctgaccggcatggagaaaccccgtctctactaaaaatacaaaattagccaggtgtggtggtgcttgcctgtaatcccaactacttgggaagttgaggcaggagaatcgcttgaactcaggaggcggaggtggcagtgagccgagattgcgccattgcgctccagcctgggtgacagagcgaaaaactctgtttc

SEQ ID NO: 109100 - DNA, 733 bp, Homo sapiens
tcctgactccatcacttccttgttgtgtgaccctgggcaagttactcagcctctgtgaacgtctatttcctcatcttttaaatgtagtatctgcctgaggccgtgtctctctcattgagccatgaggagaaatgagtcggcgcctgtaaagcctcgcgcacagtgcctagcacataaccattgctagagggagaggggagtattttggggcaactcactccagtaacagatgaccagtttggtttgatgacctcacttttcagtgaatcagcctcatttcactgaagtccttagtccttatctccttgtgaaggaataagaggggatgattatacctaacagcgaacatttattgagtgctgggcagtacatttcatgcttataaagatgcattccaagattgatgttatccttacctttgttttacgaggagaaaaccaacacaacaatgtcaggtcatttctccaaagtcacacagccattaagtagcaaagctgggattcaaactcagtctggctctgtgggtccaatgcttagccactctctgaactgagtggggcttgtgagtcataacctccagtgtaggagtttgtgcttttagtgttatttccttaactgcaattgattctcatagcaaaggtattgttttccccttttacagataagaaaccaaggcttggagaagtgaatcattaaactcactctcccttttacgtgtatgtaccccacccca

SEQ ID NO: 109101 - DNA, 238 bp, Homo sapiens
cacacacacatacaatataaggggaaaagtcaggagttagattgggacgtggtggctactctgtatgtcaactgatatttatagggtgcctgccatttgcccactgcactaggtgctgggagacagctatgaacaagccagattatggctgcatgcaccaataagggtgaattctcaaaatataagtagtggagaaaaagcaattaatagggaatatacaaatagtgtatattcaaac

SEQ ID NO: 109102 - DNA, 392 bp, Homo sapiens
aagatgatactttgggttttggacttttgagttaatactggaatgagtcaagacttcaaggactgttgggaaggcatgactgtattttgaaatgtgagaagaacatgagatttggaaggggccaagggtggaatgatatggtttggatctgtatccctgcccaaatctcatgtcaaattataatccctaatgcgggaaatggagcctggtgggaggtgactggatcatgggggcagtttctcatggtttaacaccatgcaaccttggtcctgtcatcaggatagtgagttctcatgagatctggttgtttaaaagtgtgtagcatctcccccacccaagtcctgctcctgcctgcatgtaagaagcctgatctcgttttgccttctgtcatg

SEQ ID NO: 109103 - DNA, 182 bp, Homo sapiens
gcaccagctcttgctggggcattaaaacagcagtcttctaaagaccctaaaggaaagcattgtaatttctggagctggtagcattgggtaagaaattgggcctgtggtcctaagctgctggctttaaagagatctattatgtcttcctggacagtataaagacaacccagtatcagataact

SEQ ID NO: 109104 - DNA, 432 bp, Homo sapiens
catacagtagcacgtaagttcagagtgcctcctagtggagtctagtgttgatcaagtaacattggaataattttttcattcctctaaaaaaatctcccctttggcatcatggttggttatgaatcttgggcctcataggagcacaacattctccactaaaataatgttttactcatactttttcctttcttcctttaaaaattaggtaagataccttctctgaatgtgtgaattttttatagaacaccgaagattctttgcgtttaaaattccctccgtgtaaattaagtccaaagtgcctaggcttttccatttctaatgtttaagttaaagacttgtaaattgggctgggtgcagtggctcatgcctgtaacccctgcactttggcagattcagaggatcccttgagcccaggagtttgggagcagtctg

SEQ ID NO: 109105 - DNA, 404 bp, Homo sapiens
ttcaccatgttggccaggctggtctcaaactcctgacctcaggtgatccacccacctcggtttcccaaagtgctgggattacaggtgtgagccaccacgcccagcctgcccttgtgaattttcacctgctccttacccctcacctgttaggactgtttcttgcttttgcccctgtcggtcccctgccttaacagacctaagcagctgataatgcaccaagcttccctgaccaggtggggtgtgtctatcacccaagggcagtcctacagaccctgaccaaaggccgttcctgggcggcccaaggtccaggtttcttccacctgctcttccctgtttatggggatttgcaagcctaattgcatcagcaggagcccatctctcagagaacccggactccccaagca

SEQ ID NO: 109106 - DNA, 274 bp, Homo sapiens
ctgatggaactttctttagcatatgtttaagacttgtcatcttcccatctcatctttgcagtagaaaaataccaacgtttccctgaacaaaatagaagtattttccacttccccatttctgaagctcctagacgttttatatttcttttgagtaagagattgctttgtatccaggagcctttgcatggtgccttttcttttactggtttgtttatttgggagatggagtcttgctctgtcacccaggctggagtgcattggcatgatctcggct

SEQ ID NO: 109107 - DNA, 216 bp, Homo sapiens
ctctcactcgtggtggcttattttcttccatatctgattttcttcagttgtgagttcacgtttgtttgatctttacctttcctgctctagcagtggttttcaaagtgtggttcctggacaagcacaataaacagcacctgggaattttttagaaatggaagttctagggccgggcactgtggctcatgcctgtaatcccagcactttgggaggccg

SEQ ID NO: 109108 - DNA, 229 bp, Homo sapiens
aatatgtgtgcacacagtgcacacacacggattaaaggcaaatataccaaaataattaatagtgatcatcattgtaacgttactagtaggtaaaattataggtaacttattttattcttcatatatttctggattttctacattttccataattagtatatttcttttttgttttcacaaatattaatttcttaatcagaaaaaaatacacctgaaaaacagtccttaa

SEQ ID NO: 109109 - DNA, 589 bp, Homo sapiens
gcccgtgttctgcagctcacacggcacagtcaggccctccagcttcctgccgtcaacgtaccagcacaagcatcctgtcctgcttgcctttggttaattaaaagcaaatacctctttgcagtgcagatagctgctctgtcagtcacactgggacacggtggcctcaccgcacacaatttttaattgattgactcccactcctgagacctctgggtctttcattaatcagttatatacacaagaaaggtgaagtttaatgaggtgtgtgtcaggcactctgacatgaagtggcccaggtgggtgaatgtggtgctccacattttaataatttttgacacccagcattttgcagtccacacaatgccagtttgtgataattctaataaacgcaaagatcgcttatctggtatcaagacaaaatctctcagcagcaggaacaaagactttcctagagtgagaacagaaagatcacatccttgctctgtcctagattcacaccaggagctactaagctgtttggtgagtcagaaaatggatacttaattcagccattcagccctatttcagtgagcggccgtataatgcagtt

SEQ ID NO: 109110 - DNA, 422 bp, Homo sapiens
attttcggcttcctcctaccacgtagggtttaggttgaaaagttttctcttgtcgtgaactcactggccacttgtctgtcggctttccagcttccaaaatttgttgaatgcactagcctcgtctttctctttgtccctgtaactttaaaattaatttgtttttcaaaatttttcatcttagtggaattgcaggaggtatttgagatacacatacacttaactagaagttacatgcaggaaaattattcctgttttctctgaatacacaacttctccatacccagtgtgtgtgtctctgtgtgtgtgtgtgtgtgtgtgtgtgtgtgtgtgtgttttaatgtgattttctctttagcacacacacttttctcataatctctgctcatgtatctgtggttcttggctgtggtcctgtttgctct

SEQ ID NO: 109111 - DNA, 386 bp, Homo sapiens
gagcacttgggtcttggtacagtggctcacgcttgtaattccagcactttgggaggccgaggtggagggttccttgaatccaggagttcaagacaagcctgggcaacacagtgagaccccgtctctacaaaaaatacaaaatttagcctggcgtggtgacatgcacctgtaatcccagctactcaggaggctgaggtaggaggattgcttgagccatggaggtggaggctgcagtgagctgggattgcaccactgtactccagcctgggtgacagagcaagatcctgtcttaaaaaaaaaaaaggtgtatatctatatatgcacttggggaaaagaagaatcctagataaaactctgaaaactctcgctaacaccctctgccaccc

SEQ ID NO: 109112 - DNA, 395 bp, Homo sapiens
aaagaattgctaaagagagaatagagagtcagacaggaaaaaagctcaggctagaaagtttttaaaaactatagcatttaaaggttggagaaaaggaaggggtcatttttcgttttggtaattttcagataaaactgaagattggtatgaatatttagaagtcacttacatactgatgataattgagactatgagaataaacatgttcccagtgggaaagtaagtataaaaggtaaataacaagtactctgtattgaggacctccgcagttaaatttaatggagttgcaagtaattgaaagttaatcaaaggatattatagaaatagtgtaggcaggattttaaagaattatgaaatcaaatatagctgagagtttgaaattttttccttttttt

SEQ ID NO: 109113 - DNA, 422 bp, Homo sapiens
ttttttgagacagtatctcgcactgttgcccaagctggagtagagtgacaccatcttggctcactgcaacctctgcctcctgggttcaagtgatttcgcctcagccttcagagtagctgagactacagatgtgtaccactatgctcagctacttttttttagaaggggggtgaggcagggcgtggagatggagtctcattctgtcgcccaggctggagtgcaggaacacaatcttggttcactgcaacctccacctcccaggttcaagcgaattctcctgcctcagcctcccgagtagctgggattacaggcaacagccaccacacccagctaatttttagtagagacagggttttgccatgttggccaggctggtctcgagctcctgacctcaggtggtccacccacctcagcctcccaag

SEQ ID NO: 109114 - DNA, 251 bp, Homo sapiens
agactgggagggtgagttaggtagaaggatataagatttggtgtattctttgttgggcacaattgagattgctgctcatgtttaaatccaacaaatttcagcaaaaggtagtgagttagatgttgttaatcttggggtttctcagatgagtatgactgaataaaagtggtctcgggacactgcttgggtgatgggtgcactaaaatttcagaattcaccactatataattcaaccatgtaaaaaaaccact

SEQ ID NO: 109115 - DNA, 308 bp, Homo sapiens
ctgcatccggctgtcacttcctttcttaaatcttccaacatgcttaccgtggctggtgaggctgtccatggtcaagcccctgcctgccctccgtccctgtgccctttaccttggtctagtggcactggcatccagctgttcctcaaacagggcaagccccttcacactcagagcatctgcacttgctctgcctgcggcttggagggtattcctcagacccttgtaagttcactcccacgttttatgcaagtctctactcaaatgtcatcccagactgcccttgtctaaaatagctaccttcacctaca

SEQ ID NO: 109116 - DNA, 209 bp, Homo sapiens
cacaaactaaacacaatctgaaatataaaaataaaactcttcaaaacatataaacagtagactgtagaaaatgaatttttttcaggtaaaaaatctttcatatacatgaatggcctatagaataagcccagttaaatctattttatattttattttacatatagcaacatttgcattttggaattcacagtttggggagttctgagaaa

SEQ ID NO: 109117 - DNA, 901 bp, Homo sapiens
aaaaatacaaaagttagccaggtgtcgtgatgggtgcctgtaatcccagctacttgggaggctgaggcaggagaatcacttgaacccgggaggcggaagttgcagtgagccgagatcgcaccattgcactccagcctgggcgacagagccagactgtctcaaaaataaaattaaaaaaaaaaataaaataaaataaatagaaaaaaaggaaaaagaaattattaaaactgtcttagttttgattcttggtttaatccagttcaaactggtctaagtcaaactaaaggaatttataataaggacacaagagttttgtttttgcttttgtctttttcacagactccaggagtagacatacaggccaggtctcacatgtaaagcatcagaacacctttagaaaggcaagcagcacctctctgtttcttgcctctgcatctctctgtgcttctgtttcattttctttcaggaccttctgctttgcacaaaggtggtatgcaatcagaagacgtctgaggagacaagtatgcatctcccaccacaacattatatgatgcttggagtaaaaacagtcctccctgttcctacccacgaatgtattattcaataaagattgctgccaggcatggtggctcatacctgtagtcccgcactttgggaggctgaggctgggcagatcgcttgagaccagggtttgagactagcctggacaacatggtgagccactatctctgcagaaataaaataaaataaaattagccaggtgtagtggcctgtgcctatagcctcagctacttgggaggctgaggcaggagaatagcttgagccctggaagtccaggcaacagtaagccatgatggtggcactgcactccaaactgggtgacagagtaagaccctgtctt

SEQ ID NO: 109118 - DNA, 293 bp, Homo sapiens
ctgcactccagcctgggccacagagcaagaccctgaaaaaaaagaaagaaatatccattaatattttcttgaatgttttaaatcagggatcattattatattttgtcaaatatatatacttgattaaaggttttatatttcctacatgtatggagataattatgtattttttctgtttggatctatgtgtatggtatattaatggattttttattgtctcaacttgcattcttgaaatatattctacttgattgtagtgatcctattatcctctacaagagtggcacatttgt

SEQ ID NO: 109119 - DNA, 629 bp, Homo sapiens
gctgcacatgttactgtgtgttggggtaagaaacatacatgggcacagttggtcagatatgagaccacagggatttgtgaggcatgcccttagtattcatgattatggtttttgctttgttttgtttgagatggggtctcattctgtcacccaggctggagtgcagcagtgccatctcagctcactgcaacctccacctctacgctcaagcaatcctcccacctcagcctcccaagtagctgagaccacaggcacgcaccaccacacctggctaattttttgtgattttggtagagacagggtttcgccatgttgcccagactggtcttgaactcctgagctcaggagatccactggcctcagcctcccaaggtgctagggttataggcatgagccaccgcacccggccatttatatatggcatgagccactgtgccatacctaaaatcagctgctgcagaactaaaatgagcagattgcaattgtggccaacaccattttttacccaaaaccattttcccatcttccttgctaacagaacttgatttgggctgaatcaatgtgtccagatcagtgatagatctacactggtctatgccaattatgacaatcttattccctaactgatc

SEQ ID NO: 109120 - DNA, 367 bp, Homo sapiens
ggagagctgaccatagttaagactatcaaaattaaaaacttttgtgcatcaaaggatattatcaagaaagtgagcagataacccacaaaatgggagcaaattatttgcaaatcatacatactgatatgggtctagtacagagaataaagaatgcttacaaactcaacaattaaaaaggacaacccaatgttaaaatgagcaaagggtttgaatagacatttctccaaagaaaatatgcaaatgcccaacaagaaaaatgctcagcatcattactcattaaggaaatgcaaatccaaatcatgacacatcacacccactagaatagaatagaaggcaattacagcactggtgagggtgtggagaaact

SEQ ID NO: 109121 - DNA, 854 bp, Homo sapiens
cgtggtggcacacgcctgtagtcccagctacttgggaggttgaggcaggagaatctcttgaatctgagaggcggaggttgtagtgaaccgagatcgcgccactgcgctccagcctggtgacagagagagactgcgtctcaaacaccaaacaaacaaacaaacaaaacccaaagtttaatttttaatttttctggttgttcatgtggctcccaacatttatttttgttgtacgtttagttccttgactactttggatgattttttattttcactttgtatttacaaattttaaaacacatgaaagttgagaaaatatacccctagcaatcatattcaacaacgaataattcccttataatcttttcttacaatttcatatatttctctattttagctttggaggagctagagaattttaaagcttgtctttgaaaagtgcatcatgtgtttcaccaataaatacttaattatgatctccaactgatacagacattttaaaataaccatcttgccactatcgtatatcatagtattaaaatttcctggagctggggaggcagaagcttcagttagcgagatagcaccactgcgcttcagcttcggtgacagagtgagactcataaaaaatatttttaattctttaatattatgtaatatacagtccacaaatacatttgcaagattgctttaaaaagcattttatggtgatttgtttaagtcaggatacaaacaatgttttactatgaccctattcatttatagactacttgttcttgaaaagagcagggagttagaaatagattgaacaccctcttcaaagtccttccctagacatggcaatccacttactgaaa

SEQ ID NO: 109122 - DNA, 286 bp, Homo sapiens
aaacgatggtctatcaaatggaaacttacagatcagagaagatgcaataggtctgagttgtgaaacagaaatttgctgattgctttaaaatgtatacaatgaaatggcgtattttaacataaagttattaaatgtaatgtatttaataaaatatgttatatgtattatttataataatttaataaaattattaaaatgtaaaacattttatttagtgtaaaataagtgttctattgttcatcttctaaactggctagatttgtacaaagtaagtataatgctaaca

SEQ ID NO: 109123 - DNA, 782 bp, Homo sapiens
ggcaatctgcctagtatacgtttgaacttcttgcccaaagatgtattcccactgtgtttggccatcaccttttccttgccttaaattatatctgtattaaaatgatgcggcctttaaaacagtgctagagaatacataaaaaggaattaatttttaaatcaaaatttatgaacttgccttataacatttttatgatagccctatttgaattatcttcttatctttgactaaaatagaattcgatttttctatggggtatttaacattttggatcataatcatgctagggatgaattaatagatcttctgtgagtgaactgtcaagacagatccccattgggtttgaaatgtaattaaaaatgtcagtgaactcacttgaagtccacagagtgctccagggtcccctcgaaaacgttagtcaaggactgaaaatacttaccaagtgcagtgaacataacgcagctgccagctctccacaaccaggagggcgctggtcacctttgtcaggtgcctctcatcttaacttccttctagttttggagtgttcgtctcagaagtcttgaaactaggggtgctttttagcccaaggctatgggtccggttggtggcttctcaacaaatggctggtgcaacagacctccaagagaggaacgagtctctaaacaatatccatgccctttgtaacccttctccgtcattagactctcagactggccacctttccaatgggcagactcccttttatttctgggaggcttttaaaggtggggctcattgggagg

SEQ ID NO: 109124 - DNA, 479 bp, Homo sapiens
atttgagctgagtccaatatgatgagttaagatggcacaatagtagaatagagtgacaggcattctagagagaatggcccatgcaaaatctcagaggatgggaaaggcttagcgcatttcaggaaccaaaaggtcagtgtggctagagtgtagtgaacagatggcatagtggagtgcactacaattaggtagacagggagccattctcttacaagttttgtcgtttttaccaccaaaatgtattgcaagtgtatctccagggcactaccctgtccaagctgccatcaactttgccctggaccacctttcttccattctagccctcctccagtccagtcgttgtacagagctaatttttaaaaaataacctattaattataccatctccctgcctaaaacccttcaaaggatcctattacacattaagtaaaatttaacgatctggtttctcaggacagtgcaaaggttatatccttgtt

SEQ ID NO: 109125 - DNA, 346 bp, Homo sapiens
gccagctccccgcaggggcagacaggaccttttgggaagggtggggtgagactctccagtgtccgactcctctgccacccatctcctggtcaccctctcccctgttctctttgaggggaacaagcagggcccggcccaggcaccttttgtggggatgagtcgttgctgtgacctgcccgagtgctggccactcagttgctcccaggagccactgtgcctcatttctggctgcctgtgttctcccaggggtcagcagataggtgcgattaggtgtttgaatgcttgccaagttgccctccatcaaagctgtccccattcacagtccatgtcccccagccctgaggga

SEQ ID NO: 109126 - DNA, 642 bp, Homo sapiens
atacaaatgagttcttatgcaatctaaatattgctaaatatttatttgtaaccttgtttttgtgggaaacagtattctatatggtcatactgtagacatcctggagataatctaatattgaaggttgatagggataggtctgaaaaggaaaaagctgagaagggaagggatcagagtccttgaaccatgtagtttgcctagcctctcctaggggtctgcacatccacaaagattaataaattttaggctctatctatcatgagtttatattctggtaagggagataaaacctataatcgtttcaatatatgtaatatattcggtaatacctgtttttttaaaaaattatactttaagtagaatacctgtttttctaagatatttgaagggccatagagagaatacttatgggtcagagggtcagagaaaacattaagagaagaaagtgacatctcagtatgactttgggggatgaacagtaattttttgatgaaccaatggaactagaaaaaggcgttttttacaggtttgaaggtgtgaaacaacatgatcattttcaggaatgacaaagtagtatggtatttaaaggagcagaaagtatgtgttatacaagaaaaggaacaaaagctaggaagtgatgaa

SEQ ID NO: 109127 - DNA, 568 bp, Homo sapiens
tgagacccccaagggcaggccctaatccaagctgattggcgtccttataagaaaaggaaattgtggcacacagagagacaccagggatgtggagagacagagatagacgttggcatcggtcccagcaccttcaagttcacctgtgcacacagtcacatggtaccgggccactggcaggcagagagagggacatcattgctgacagccccctgcttcccatccctagccctgctgctcccacttctaagctctgattcctcctctccttctagttctcatctgggctgaccttcccccttcctcccaactatctaaatcctaccacacaccaatcaagagctgagtcatccccaagtctcttggcctaggcccttggtcattataggtatatggattccatttaaatccatgggatcaaatgagacagaccagaggttcccaatcctgtcaattatcagtatcctctgggaaacttttataagaattcagattcctgagccctgcttcaggtttctcaactctgaatttccagagctcagtctactaaacgtgaattgcttccaagctt

SEQ ID NO: 109128 - DNA, 378 bp, Homo sapiens
tcggtactgacagatcggcttcatcctctggtcattttaattgacaactgtaatcttaagaaatatcaaacccaactgcatcacactacacagtcatttctcttctgcctgtgactgcaaagatccacttctggagatctgtttgctctgaggaggaggaaagaaaacgcaatgtggtccaaggactatgtggtgacctcacagtgccattaagcctcaggttttctcttttcaaatcttaaacaagcgattcctttcttttatttactttctttttttttgagacagggtctcactctgtcgctcaggctggagtgcagtggcgggatggcagagtctcactctgtcgcccaggctggagtgcagtggcgggtggca

SEQ ID NO: 109129 - DNA, 163 bp, Homo sapiens
gtaaagttaatgatttttttaggaatccaatgcagaaaattaattatttgccaaggttattttatcctgttctgaaaatggataaatttgacacagttccagtagtatggttttgtggttggcaggagaaacggagacaggtaaggaattagcatatacggtg

SEQ ID NO: 109130 - DNA, 658 bp, Homo sapiens
cagatgtcagaagtgaaactgaccacaggcaagtcagaggctcgccaggagggccaggtcacaaccccacagctcccagccacccacgtggcctgggagacacacacacacacatacacaccacagagagagagagagagaatctggctccagatggcctagcaggaggcattcggcaggcctggcctggagttaggcaggcaggcccctcccttgtagctctcgtgggcaggtcctaacccaggctcctgacagcctggcttcgagccccgcctggcccaggcctgggagctcccagggctgtagggctcctggccctgggcctgtgcctgtctctgaggctcagcctcagcccctgctggttgtttggccaagtcctccggggagactggcttgtggtcactgaggaagacaaagggaggcttgctcttccagtaaaaacagcaaacaagcctgcctgacctccagatccagggagaagggccagccaggcccagccagagtcagacaagggtggaggggaggttctctgtcttccattcccctcctacgcccccagactgtgaggggtgtaaggaagatggaagatgttgcgggagggattcagagtaggtaagagaaataatcctggtacttggaaaatcagtgtgatgggaaa

SEQ ID NO: 109131 - DNA, 261 bp, Homo sapiens
ttttccagggtgagtaagtcctcctttactgatgagagtggctctccttgagtgcagtatcatataatagttcaagagcttggttttgtttagaaatagtcaaaccagggttcaaatcctggctctgccacttccaagttctatgaccctgagcaaatgagtagacatctctaaacttcaattttcagatatgtaaaagggctaatggcatagatatcatagacgcattataaagattaaactaagcaccttaaacacaaa

SEQ ID NO: 109132 - DNA, 1107 bp, Homo sapiens
agtcaatccagagcctcagcaagcagcagctggaaacggggaagagggagcagacaggaagcgggaggtcagctgtacacccagggtaatagaacttctaccctcagaggagtcaaagaggaggcagaactatggcaggaaagctccggaagtcccacatccctggagtgagcatctggcagctggtggaggagatccctgaaggctgcagcacgccggactttgagcagaagcccgtcacctcggctctgccagaggggaaaaatgctgtctttcgggctgtggtctgtggggagcccaggcccgaggtgcgttggcagaactccaaaggtgacctcagtgattccagcaagtacaagatctcctccagccctggcagcaaggagcacgtgctgcagatcaacaagctgacaggcgaggacacggatctgtaccgctgcacagcagtaaatgcgtacggagaggccgcttgctcagtgagactcactgtcatcgaagttggctttcggaagaatcggaagaggcacagggaaccgcaggaagacctcaggaaggagctgatggacttccggaagttgctgaaaaagaggggcccaacagtccccaagaaaaacggatggaccttgaagcagatatgcgcagctggctgatgacagccagacaggaagggactaacgagaagatctgctggaaggtaatggcatcggcgactaacgtggcatggtgggcaggcctggagcgcatgagaagggaccgaggcacagatgggacacggaaactcgaagaccaactcccagctaagaaacccacccgggggccccaggcgcgacacgcaagcttggactcggaggccgagaccaacaagagagacccaaaacgaacgaggttacccggtatagagaagggcgaaaactagcccccaagagacgtaaacaagaacaacaaacagcagacagtggccaacagggagaaagccagtacaccacacaatgaacgcgtcgcgaagacagagaatcacacgacaggaagaaaagcgccaaccacaaacagcagaccaacccccagacaagaggaaggcgaccaccatagaaagcagaaagaaaacag

SEQ ID NO: 109133 - DNA, 1885 bp, Homo sapiens
cctgcctcagcctcctgagtagctgggattacaggtgtgtgccaccatgcttggctaatttttgtatttttagtagagacggggtttcaccatgttagccaggctggtctcaaactcctgaccttgtgatctgcccgcctcagcctcccaaagtgctaggattacgggtgtgagcaaccctgcccggccagtaaattgtatttttttaatgacatcattgatttgaagatctagatggcataaattacgacgtctgccatcgcatattagaaaggggacagtcatatttgtaacgtggagagaacacggagcaccagtcaccacgtgcacttaggatgcagagcttaccgcgcaccgctgatggggacctccggaaagagcggtgccttgtggttggcctggaagttctctcccaaggtgaaattcctttaaaacctcaggctctgacctatgtctttgaagcagctgctttgtagagtccctctctttactgtcctcgttaggactgttttgtggttccatgaaaatgtttagcatccttgcagaattacttgagaaggggctggtaccagtgtaaagaatctatttctgtaaaactacgaacttttgcatagggaatttattctaagcaggtcatagccgtgatccagagctgctgctgctcactgccagtccttgcggctggcggcgattgccggacagactctctgtggcctggctctcatccttggcgtgtcagcctgcggcaggctgccagccatccatgacaatcatgtgagctcagccacagacctcagctggcggtttgatccctggcaggtccctcgagcagtactggtaagaggcttcacacattttcccactcttacagttcatttttcatagtaggaagggcccttggcctccccagtgcctcttccagagcctccaccagcactaagctcagaggaaagaagaaaagggccaggagtcagacgtcacacccgggggctcccctttcccatgtagaagtgttggcatgcgtcagtctcctttacagaggggtggatgtatccgtggaggaggggccttctctctttctaattgcactatacttgttctagcttcagtctggagatacttaagacctccatggggtcgtgatccatagacttagcaagtcttgccttatctatggagctcgatggtgagaattgtgaccattgtctgatgtccatagttccttccccctagattgtttctttccacggattgtgttcatctgaaccattttattttttatttaccaaagtactgtacttggctatttgcagtgttttcaaaaccaaatgtttctttttttgtgtttttaatcttcgatacttggtgcaatagaagctgcaaagatgtgccactttatctatgaaatggagttttgtataccaataaattctagtttaaaaacaaaaaaaaaaaaaaaaaaaaaaaaaaaaaaaaaaaaaaaaaaaaaaaaaaaaaaaaaaaaaaaaaaaaaaaaaagaaaagaagagcagcagacagacagaaccagaaaggagacaactacaaaacagaaagaaaagagcaagtaaaacctcacagcacgaacgcacacccgcgactaaccgactagaggtagcagagcaacatcacgaacagagagacgaccggccacagcgacagcggagccacacaccaggcagggggcagcggcaactcagcgggaggacaaaaacatacaaggcgccgatacccaacaacggcgacgaaaataaagaacggaaagacaacgcgacaatatccgcaccaacaccgccaaggaaacaccgcaacccggacgtgggcacacggacaaacgatcagagcgagtataccacggatggggaaa

SEQ ID NO: 109134 - DNA, 1447 bp, Homo sapiens
cctgcctcagcctcctgagtagctgggattacaggtgtgtgccaccatgcttggctaatttttgtatttttagtagagacggggtttcaccatgttagccaggctggtctcaaactcctgaccttgtgatctgcccgcctcagcctcccaaagtgctaggattacgggtgtgagcaaccctgcccggccagtaaattgtatttttttaatgacatcattgatttgaagatctagatggcataaattacgacgtctgccatcgcatattagaaaggggacagtcatatttgtaacgtggagagaacacggagcaccagtcaccacgtgcacttaggatgcagagcttaccgcgcaccgctgatggggacctccggaaagagcggtgccttgtggttggcctggaagttctctcccaaggtgaaattcctttaaaacctcaggctctgacctatgtctttgaagcagctgctttgtagagtccctctctttactgtcctcgttaggactgttttgtggttccatgaaaatgtttagcatccttgcagaattacttgagaaggggctggtaccagtgtaaagaatctatttctgtaaaactacgaacttttgcatagggaatttattctaagcaggtcatagccgtgatccagagctgctgctgctcactgccagtccttgcggctggcggcgattgccggacagactctctgtggcctggctctcatccttggcgtgtcagcctgcggcaggctgccagccatccatgacaatcatgtgagctcagccacagacctcagctggcggtttgatccctggcaggtccctcgagcagtactggtaagaggcttcacacattttcccactcttacagttcatttttcatagtaggaagggcccttggcctccccagtgcctcttccagagcctccaccagcactaagctcagaggaaagaagaaaagggccaggagtcagacgtcacacccgggggctcccctttcccatgtagaagtgttggcatgcgtcagtctcctttacagaggggtggatgtatccgtggaggaggggccttctctctttctaattgcactatacttgttctagcttcagtctggagatacttaagacctccatggggtcgtgatccatagacttagcaagtcttgccttatctatggagctcgatggtgagaattgtgaccattgtctgatgtccatagttccttccccctagattgtttctttccacggattgtgttcatctgaaccattttattttttatttaccaaagtactgtacttggctatttgcagtgttttcaaaaccaaatgtttctttttttgtgtttttaatcttcgatacttggtgcaatagaagctgcaaagatgtgccactttatctatgaaatggagttttgtataccaataaattctagtttaaaaacaaa

SEQ ID NO: 109135 - DNA, 5079 bp, Homo sapiens
  misc_feature (3902)..(3902): n is a, c, g, or t
  misc_feature (4090)..(4090): n is a, c, g, or t
tgtttttatgttaaaccaaacatgtctcttcggaacacagtctgtatacaaataacatgcatgaggactttccatttaatctgtgattcagccacatgatgtttttgccaaatgatgtgatactttccaaagcaccttgagtgtgaaatgtcaacagaaatatcagcaagcttttatgttgcagagtattatggtacctctgaattagcctgtatagttctcttcctgctttaagcattacctggttagctcagacggcttgaggcagtcccttaataatagggatgcttttcatctctaaggatgtaagaggcaaacaaatcatgtcattctttaagtgggctatgctttgatagatgtgctctttaaaggtgtgagattggaatttagagttgttaaattgaaatgtttgcattgcaccaaaggagctcagttttcaaactttaatggaaccttgggtaaagggaaaaaatttttaatgaaatctggggttttatattttgattagcctaaaagtaaaaatacagctttatccattaagtgacttttaaaaatcagttttgccataccaaagaaattagattcttagtgtcacatgctatacttttgtctgtgcttgaaacgagcaatgccaacattgggagcaatgacagaggtttgcatcagtttgtcttggctttgttaaggacttctgccagaaatgtgctcgtggttgacaacccaggatcattgttcaagttcttatgcagacacctttgaaaacaattcagatcgtgtcacaagaatttggaattgaaaatatcatttattttttaatgcaagaatacccagatgtggtttcacttcagcagtagctatagtggttcacttatatacatttctgtttcactgaatgtaaattttgaatactgaatgtaaaaaaaaaactccagttatattgaaacagtcactaagactgcacatgtgttttgcagactttcttcctgaccatttgccacatgggtctctgataagattctgttggtttaatagtcaaaataatctttgcagtttgtgagcactgagtagcaggttctggagactaccatatacaaccagttgtctaattgtgatttttttattgatgtttagaagaatgtaaccgtagagttctgtgttaagttgatttatgctcaggacataagatcacaggctaatgcaatgtgtatgtttcaggctttaatcttctcaatttccctttttaagccgttgatggtgtttaagattaacatgacagtcttgtatttttaccagatactgtattatttttcctattgctgctgtaacacattaccatgaaggtggtggcttaaaataacacaaatttttcttaagttctgcagatcagaagtctaacacaggtctccctgggacaaaatcaaggcgcttgcagggctgtttctttttgaggctttagggaaaaatctatttccttttctagttttttaaggctgggaacccctccttccatcttcaaagccagccatgtagcatctctctgaagctccttccgttatcatttctctttgtccaaccccagctgatacaggttatctaggtttaaggattccagtgatcacattgagcccacctaaataatccaggataatctccccaactgaagttcctcaacttaatcacatctacagagttccttttgctatgtttggtaacatattcactggttccagggatttgggcatggacttctgtaggtggccagtattttgcccacaacaggtacattctttctgtggaattctgatccctgtaaaatgtctgtagcattaaagagattggaaatctgaggtcatgtgccccttggggatctttaaagattaaaagcatgaaaactttgacttgtagcctaccaaaattatacactaaactttctctccaaaatacttgtgaaacaatttatctttaaagtttctgaatatgtgcttcataaaataacatctcatgtttatcagcaagtgtcctaaatatttgcgtctaactttatggaatttattcagaaaaagaattgaaaactcttcttatagttaccctttctccttttctcttcagtggttatgttgctggggaagagttgggggaagacctcaaaacacaggaactcagagtgatgaacaggaccatgctcaagtttattctttgttttcttttaatgacatattcacaacattcacaactttctgcctttaaatctggttcctctcttcagcttcaccaagccactgaatgcttttcagttttattaaccctcacattccccatccttctcagcaagagcctctccttatgccatcagcatgtatatacatttcctaggaaatttgatctttcttgtcattcttttttggttccaatcggccttttcctggttctcaaagctctagtttcttctaatttctggatcatcgcaagtctggccctctttgaactttaaaacataatgtctaattccaccccaattttcagcatttcttcaactaaatcgataaagctgtctccattatgagaaaggccagaataatactccgagtaagcataagaaagctggtcattttacaacttctcccgactctaggaagtaatatgatgccatttgttgagcatctacagtgtgccaagcacatggttcatctctgcaaactgctgctacattctgtaaagcaagtattatccgcattttagggattaggaacagcttcctgatctcttgccaaaagtcacagctagtgagtggtttaggcaagatacaaaccctagttagttaatccttactcagaagtgtataggactatgatacattgtctcagcttaaaaaaaaaaaaaaaaaaaaaaggtatttaatcacccagggtcatagtgccttccatagtgtgaccagatacaactgttttttccttgtatccacaaaagccaggttgtgtcagaacaacctttctacagagtaataaccaatcgaaaaagagaagactaccttatttaaatccacttattcacaggagggattaaggcggctgtaactcatcccttatcatctcctaatttctctcctccaaaaccttccatttatctcagctaaaattgtgtctgaaggctgtttgtacttagagttacattacaaataaggtaggcatggtttctagagtccttttctagtcaagcatttccttattcgacaatgtcttcagaattgcattttatcttttgtaattttctgtagctcccatattccaaacaggaattcattgacttgaaaaagtcaggtgtgtaaacagtaatcctttcttgttaggtctgaagagttcatgattttttatgaatataaactaatttattatttgcattaatgtaggagacagcaaagttaacggagagtcataaaacagaacaagtataagttaggctttggagcacctaagttctaatcttgacaattttgagaatcgtttggtacaaaaattcttaaactgtttctgtgccttctccatccatgaaatgaggataatttttttgtgcaaaatgaaacaatagtactttgaaaacttaagagaaaattcaagtgtaaataatcataatctgaaactcatttgtatgaggctgtgaaagattttacagactctttcttttcaagtcagcctttgcaattatattttgcctttgttgaaatgaaaaatgtttgcatctcccgtacgcatacacaaaaccaatagaagaaagtggttggtaaaagatatagctgaaatggaaacactcatatgttaggtggataaaatcataagagaaaatgggaattgactgtactttcaaagtactaaatttgaagtcatcttactccaatttaagtcatntatatatatatatatatattggcttttaaagagttaaagagagaatcagatctgtccagcaggatagatgggtgaggagaaaagtacatatttaggatttttctctaaaagatctttttcaagattatggagtattttaatatttctgcaaactattccaaatgaatgcattttatatagggcaacanatactggcacctgattctggtttattcgagttcatatgtagggtttgttgggaagaattatatgattggcttctttttttagaggaaatattttcccttttttcttatccatatactattctgaacagctttgcagatttccttaagttcatagcttgtaagtagttcatggtatatagacatagtcttgacttacaactgaaaaaaaatttatgttacagaagtttattttttctatggaactgtctttaaaaacaaaaatattacaaatcttgaccttgaaatattctgtttcctgttatcacattctggatatctattttgtttgcaaatgaaaattattactgatgattagcaacttgagcctgttaataggaaattgcaaagcctgaatacacacacattgccttagcctatcagtagagtagaggacatatgttaagaaaatgtgtctgcttgttgctgttgttggacaaaattttgtgtctgtgtgtatgatttttttttttctattttcttcaaagatgtgaattaaatgaaagtgtgggagccagttaaattattttgtattatgggtgttctggatcctttcactccgtataccattttcttgtaagggcagcatttgtagacttgctaatggactgtagagctgagctatattaattttatacttgactcaggggatcagttctgtgaatgccattgcacgaagaaagcaaatgtttgccttgattttgaatgtatctttttaatgtcttcttaaaacatatttgtttaataatgtagatttgtttttttttttctagtatcatagtaaatattgcttagtacttgcccccaccccactgggtagtttatatactaccctataggtcatgccaaaaatgaataaaagtttaaatgccaaaatgtttatgaaactgctgtctaaatactgattgattgcacaatttaaataaaagctttccttagttaaaaaagacaaa

SEQ ID NO: 109136 - DNA, 740 bp, Homo sapiens
cttttcagtctcaccagcccctgaccaacattaatctgtagatttgcctattaaggacatttagaataaatgaaataatacaatatatactttttcataaattatgtagtcactttttgactggcttctctcatatttttaaggttcagctacactgcagcatgtgtcagtatttcatttctttttattgccagatcatatcccattgtataaatatgccagattttaaagtgtaccattctgtaatgttaagtatattcacattgttttgaaacagatctctgggactttttcatcttacaaaactgaaactatatactccacattttatttacccattctcatagattgggttgttttccacatttgggcagttgtgtataatactgctgtgaacatttgtatgcacgtttttaggtggagatatattttcatttttcttgcgtgtattctgcctaggagtggaattgaagggctagtcatctggttattctttaacattgtgaggaactgccaagctgttttccaaagtggctgcaccattttgcattcccaccagcaatgtcgtttttgatttgcatttttctaataactaaggatgtagaacatcttttcatgtgaagacatttaattaaaatgttttccttaaaataatgttttactagattctcagggttataacttagaaaggaaacatccttttagaattcttcaaggatactaattgtaacccaaattat

SEQ ID NO: 109137 - DNA, 308 bp, Homo sapiens
agggatttcaatgtcctgtgtctgtagcctcaggccacaaacacagctggcctgcccttgcctgcaggctggcagtttctcagtctgtccagcccctcagtcctcttcctgggggtagctacagtcccccatctgctgtcttctgtcactaccctgggggcaggggctggagtgccatccaggagcacctcgtcagcagcatgggcaagaggcaacacagagaacaagaccacacaaaactggctgggacctcaaagctgctttctccctttcccaggaagccacaggagtccttctttgaatttctc

SEQ ID NO: 109138 - DNA, 485 bp, Homo sapiens
aatcctttgtgtcaaatcattttcttgcaggttggggagttaatggtaactttgtctgaagcccagccaagccagaaagcctccacggatgaggcgtggtatgctcaacctcctcgaaaaaccacaagatgagaatgtggaaatggggaactttctagagcagatgagtatgggacaagtctgcatgtgccacatctaatgggaagcttaaaccttcctgtgtatttaggcatacagtagttcattttaagagggttttcctctttctgaatcatcatggtgtttttattgatacctgtagtttggataatcttttgtgcagccaatatttatatattctgcaccattttgaaagccttctactacctggttacctgtatgtatcgtgtgatttcaagaagttttaccatgtttttgtcctcggatttactttgtttacctaaaaaatgaactattgttttagaacagtgataactcttactttg

SEQ ID NO: 109139 - DNA, 374 bp, Homo sapiens
taacaaacagaacacaacaaaacaaaaaacagctgggcatggtggtaagtgtctgtagtcctagctattgggaggttcacgtgtgaggacagcttgagcttggcagttaggggctatggtgagctatgattgcaccactgcactccagcctggaagacagagtgagaccttgtctcaacaaaacaaaacgacagcaacatgtggagtaattacaaaacaccttcagaattctggcactctggtctagatgctcaaaattctcaccaggtggcaacggttttcacaggcacaactgggaagttaatggacagcagagtgggcaactgtgaagtcttctatcattaactcaaacttataacagccataaacaccaa

SEQ ID NO: 109140 - DNA, 331 bp, Homo sapiens
attaacaataactaatgataaaatacaacagttatgtgattgtggtctctctctttcaaaatatcttattgtatgtaatgttttcagattgtggttgaccgtgggtaactgaaaccttggaaagcaaaatcaaggataatggggggtactcctgtagatccaaagcatttcagttcagcattaatagggacaggaattgccaggccactagagtttcactttctcttctacattcccctttcctttcctgcttttgggcataggggagcatttgtttgttttgtatacatatctcttatctctgcctacctgaaatttatattctagtcaa

SEQ ID NO: 109141 - DNA, 397 bp, Homo sapiens
ccccaaatatgtacaactattacatatcagtgaaaataaatatttttaaagatttaaaaattgtctcctgaagttatgtggaaagcagaacttataaaagatgaaccatttatttatttattatttattttaagtacagtgtgtggaagtaagggatgagctttgttgtgcagcaaaaggagattttcatccaatgttgccaatgctgcttggtttctccttgatgcttagagtaaaatgtgagtgaagcgagagagagagagagagagagagagagagagagaggaaaaccatggcacaaaaatgaactaggactgaattgtttagaaaaaactccacctctccaggtggcaaaaggtgctaaaagtcaatggctgtggaaaatgtgacatagaga

SEQ ID NO: 109142 - DNA, 171 bp, Homo sapiens
agcccactgggcgcccccctcgggagcgcgggcacgtgtgcagcagtttactgcgcgcccccgagggccggggcttccccttccccgcccccttggctttcgcagtcaaatcccgctctccgcccgccgcccgcggaagtctcaccgcgcagcagcacccccagcccgggc

SEQ ID NO: 109143 - DNA, 276 bp, Homo sapiens
caattttaggaagtaaagagagttaccttctaaagtcaaaaggtatgtacacacacacacacacacgaggttgtactaaatatatagctactcaaagatatgtatatatacacaaatgcacacacacaagtatgtattggaacctatacatttagtaccacttattttttgtgtatggtatacattcatttccttgaaaatgaaaataagttctttgcatgtaagaatggacatccaaaatgtacccacaatgatataaataaaaaatacttttct

SEQ ID NO: 109144 - DNA, 1080 bp, Homo sapiens
ggtattttgatagaggttgcattaaatctgtagaccactttgtatagtatggccgttttagcagttcttccagttcatgaacagcagatagctttccatttacccacatcctctgcagtttctttcatcaatgttttatcattttcagtgtagaaatctttcacttccattattaagtttattcctgggtatttattttttcgtagctattggaaatggaattgttttcttgatttttttttcagatagttcactattagtatttagaaacactaccaatttgtatatgttaattttatatcctgcaactttactgaatttattctaacacttttttggtggagtctaggatttcctatatatgatatatcatctgcaaatgggacaacttcttcctttacaatttggataccttttatttctttctcttgcctaatagctctaagacttctagcactgtgttgaatggaagtggtgaaattgggcatacttgtcttgttcctgatcttaggggaatagctgaaagcataacatcagtatgtttgtcatatatggcctttgttgtttcaagctgcatactttctatacctaatttagtgagcatttcagaaacaaactttaataattctttagctttagtgttgtttgctttctacctggatcatggggttaacagaatttgaaaatagagtgatttcattttaaaaggagattttagattagtaagaaattgttactctctgattttatttctccatttgtttcttctcaaccctgagatgaagatccttctgatatcttctaagataaaatttgttcagcatttagagcattatttttttctatttagtcctctattgtactagtacctattgctgcctaacacattatcctaaaacttaatagcttaaaataacaaacatttattacctcagtttctgtgctcagaaatcccattgtaacttacctggatgcctctgacttggggtctctcccaaagctgcagtcaagcatcagccagggctgtagtcatgtcaaggttctaattggggagaatctgcctccatacctactaatagt

SEQ ID NO: 109145 - DNA, 336 bp, Homo sapiens
tggcgtgcgcctgtagtcccagctactcagctactcagctactcaggaggctgagacaggagaatcacttgaacctgggaagtagaggttgcagtgagccgagatcgcaccactgcactccagcctgggtgacaaagtgagactccgtctcaagaaaaacaaaaaccaaaaaccccatgtggaaggccttggggtggggtgtgtgcgtggggggatttgcttccatcatccggctcatccagcacataatgtttgttatatcactatctaatgtacaatatatcttatttatctgatttgtctgtctctctctctgtctagaatataaaccccatg

SEQ ID NO: 109146 - DNA, 892 bp, Homo sapiens
tttaaaatggcctccaaatgccctgctggagtgctttctgatgttcctaagctcaggaaggcttaggagaaaataagtatattagataagcttcattcatgcacaagttataatgctgttggcagagagttcagtgttactgaatcaacaatatgttgcattgttctgttgacaaaaacaaagcttgcagaaacctaaccctgtatgttttctaggagcagtgatttggtattcactacttcagtgtttgtggactttatggaacataagtaccacaaataatgcaaattgactatatttgcagcgtgtacaatcaaggatgcagaggcagaaatgtgtgtgcagcttaggtcatagtaaaaagaggaaagaatttgaggaaaattttgccagttacatattacctctggaataactttgcctttgccgtgtgtgttactgtgtacactcagatatttttctcataatggcctttgccgtgtgtgttactgagtgagtacactcagatatttttctcataatggcatgagggaaatcagtctccttttcccattgtgtttgtcacttttgctgagacgcaaaaaataacgtgctatgatattgtgaaatatgtatttggtctttatccccaatccctgacatccagcggaatctgcagagttaagtgtcttttatatgctcatgtgatgactggtggctgggggcccctagaaagtttcaggatagggcagatccttgtggccaggagttccagatcagcctgggcaacatagtgagaccttgtctgtacaaaaaagaaagtaggaaaaaacatctttggtttttcctatctccagatacttccttttcaaataaatgaatcttctttcatgtgcataatttaaaaaaaaaa

SEQ ID NO: 109147 - DNA, 427 bp, Homo sapiens
ctaaagcaactaccatagctgtgttcaaagatttaaagaaaaatatgctcctaaggaatgaacaaatgcaaaatttcagcagagaaagaaaaactacaaaaataaccaatgctaaaactgaaaaaaatatttaaaaattacactggatgcacttagcagattataaaacaacaaaagaaagggtcagtgaacttgaaaatatatcaacaagatttctaatttgaagaataggaaaatagtggaaaaaaaatgaacagagcttcagtgacctataaaatgtcaaagccaaataaaacaaagatgactctctaaattgaaaatgttgtatttaggaagcaagaatctaatttgggtgcggtggctcatgcctataatcccagcactttgggaagccgaggcaggtggattacttgagcccaggaattga

SEQ ID NO: 109148 - DNA, 329 bp, Homo sapiens
tagctgggactgcaggcacccgccacctcgcccggctaattttttgtgtttttagtagacaaggggtttcactgtgttagccaggatggtctcgatctcctgacctcgtgatccgcccgactccgcctcccaaagtgctgagattacaggtgtgagccactgcgcccagcctctgggaagaattctttagagcacatttatctagtatgcaggtaggaagaactgtgtttagttagtaattttcttggtagatacaattcagctatagatagcagatctattttcttaacttttttttttttttttaattttctcgagacagggtcttg

SEQ ID NO: 109149 - DNA, 539 bp, Homo sapiens
agtaaggcagtaagattgcttaatttatgggcattttgggggaaaaaaagtctaagagtaaaaatactgaatctaggttaactgcctccttgtttcaaagtgaagagtaatataatgagataaaacagcccggttccaccagcgaacaagatgaaataaaaaccctggatccaagagtggcagttaggagttaacataggcttcctggaggatgcagtttgagccaagtcttactgaaagctaagagggagttggcaagacaaaggaaggtgaaagggcattcttggtggatgtgctacgctgcagcaagaaatgagttgcaacagccagctattactatcattgctgaaaaattcatcctctcctgaatgagcaaaattaagtgagacatacttctcccagctaggaaatgggagagttgactgttttcaggagcatattaaaaaataaaatcccagagttatgtttatctccctaaagtcatgtgtccaaaacagagtttttttttgttgtttgtttagacagagtctcactctact

SEQ ID NO: 109150 - DNA, 187 bp, Homo sapiens
ggctacagagcgagactctgtctcaaaaaacaaacaaacaaacaaaaggtaattgtgcagtgaggaatatgttaatatactgactacagtaatcatttcactatgcatatgtatatcaaaacatcacactgtataccttaaatgtatgcaataaaaaataaaagatacatacacaaaattctttaaa

SEQ ID NO: 109151 - DNA, 373 bp, Homo sapiens
tagtagataagatagcaacggaagtgtgctgggcccataaaaaaaagtggatagatgtaagcaagcacgaattgtaaaaaaaaaaatacaaaatatgggaggaagatatcatagttaaggtactttagagtcctgcatctttctgggggacagagatagtgattttcaattttgttatgtcaaatatacaagttaaaagtgcaaggtaactactaaaggaatagtgatagaaggtgtaattccgacaagcagagtgatcaaaaagtatgcaaacactgaaaagaagaatacatatcaacttcaagttattggttatttcctataaggaataaaaatgcatgggatatagtaagattggtaggagagggggact

SEQ ID NO: 109152 - DNA, 618 bp, Homo sapiens
gccccaaattgctgtgcctaatcctacaggtcccactgtccagaaatcaagtgtctgatggccaagaatgatgaaacatcttgcggtgactttgtgtggtcccttcccttcctagaggccttccttcccaatggccacattatttcacatggcctcagaggcagtttatgaaatggggaccatgaaggcattaccccatttccccagaaggggaaactaagaccagaatatatgtgtgtgtgtgtgtttggtctgataataccattctcattgagatgataccttattgtggctttgatttgcatttctctgatgattagtgatattgagcatttttttttgctatacttattgggcatttgtatatcttcttttgagaaatgtttattcagatcctttgatcatttttaaaaccagattatttggtcatttttaaaacccgattattggggtttttcttttggttttgctgttgagtttttgaatcccttgaatatttgggataatacatagtcccttatgggatgaatagttggcaatactttcccctataccagagtgtctcttcctttgatttttcctttgctgtgcaacgcctttaggttgtatagccccttg

SEQ ID NO: 109153 - DNA, 434 bp, Homo sapiens
acatgaatatacaaaaaatatttgtaaaatgaccatcgaatgaacaagtgctcattaagtaccaagctatatgccaggggttgctgatggttagaaatgagcagggcacaaaattctttgttcaattagtgagcaattcaggcaaaaagaaaatattaatggtgattatacaatataatgcaatgcagccatctgccactagatttctgaagtgttttgttttgtttttaagagacagagtcttgctctgtcacccagactggagtacagtggtaaaatcatagctcacttcagtctcgaactcctgggctcaaggaatcctctcacctcaacctcctaagtagctgggactacaggtgcatgccactatactggctaatttaaaaacagaagccaacaaacaaaaaacacacctttttaagactgggtctcac

SEQ ID NO: 109154 - DNA, 773 bp, Homo sapiens
ctcttaggtatttgaaaagatagattgacgatggcaaaacaggtgacggcttcaggccacagggaatatgtggtcaaatgagtttggctctattactggtactgaatccatatttatctggagaaaacaataatagctaagtagctaatttgatcaaggtttagaataagtcttttattgttgttttagcaatctccaaatcaagagttgcatctttaaacatgcctaacacttttaaacatttgggggctgttctgtaaagaattcatgactttaagtatatgtaatatccataagatgtgaatgaaaagaactacccctgcccaatctttctgaagtgagaatcagacaaaaatatttatttgttctggtgttttagggtaaatttaatgactagattgactataaaacttgattcagtatagtgtgaataaattggtttaaatggcactaaaaacactcttatacataccaagatttgctagatataaatttggcagagttattaacatgtgaatagtgaatgccacttacaaggacttttaaacaaattatgaagggtagtacaaatttaattcggtcagttgggaaaaatactttggataaaatacaggtgaacagtttagtgctacacaagtttaaaggtagcccggaaattacttcaacttctacaaggcagatttactgatctttatgtccccttgtttgaagcttttcacataatagatatatattttctggatgtatttaacccatgtctggatagctgaaga

SEQ ID NO: 109155 - DNA, 406 bp, Homo sapiens
gatatttgtttaaagggggtgcaaatgctggggccacccagtggcttcttccctggataaaatctgcctgtggtgacatcagcagtctaattcttggtcacagacccttgaagctgtcctgtgggaggggatggaaatttctgtttttctcagccaatctaattctcctctacaaaatgaggctggtttctctgccttttaatttagagaataaattcaataacaatctaacattttctctccctgttaccaaaggagaaagacttctttttgcagcaagaatgaacagggcagaattccagagactcgttggaaggaaattgctatttattcgataaaaacagatggcaatgatagctatgttgttcgttccccctttcaggcaaacgtcttaatgttatagaaa

SEQ ID NO: 109156 - DNA, 685 bp, Homo sapiens
  misc_feature (38)..(38): n is a, c, g, or t
  misc_feature (69)..(69): n is a, c, g, or t
  misc_feature (179)..(179): n is a, c, g, or t
  misc_feature (234)..(234): n is a, c, g, or t
  misc_feature (276)..(276): n is a, c, g, or t
  misc_feature (380)..(380): n is a, c, g, or t
  misc_feature (440)..(440): n is a, c, g, or t
  misc_feature (442)..(442): n is a, c, g, or t
  misc_feature (446)..(446): n is a, c, g, or t
  misc_feature (448)..(448): n is a, c, g, or t
  misc_feature (450)..(450): n is a, c, g, or t
  misc_feature (567)..(567): n is a, c, g, or t
  misc_feature (671)..(671): n is a, c, g, or t
ccttcttcaattgtactgcacccaacttgtggaaagcnaaacaatattaaaaatactttttaagaaacnctagaatatattgtcatcaaagtgatcacggttctgcttatttttggtcatcgcaaccaatgtactgagccccctttgcccagaccctagcaggtcctgagtctcagcgnccacaaaacgaggctatggcccttggggagttccgtgcggtgccacaattggccnctgagttactctagagtgataaacgcagccttggcagtaaantaccagagaggtaatgagtgcggactccgtgctccctccgcagggcaggtgcgtgagctctagcgccacctcgtgggccgtgggattcgtgcccatctcctccngggcgggagttcctctggagccaggaactctttgggctcagggtgtcttttagaaaagcntntgangntngttcttctttagtggaccttctccggtaaaacggggttaacaactccaaacttttccccacctaaagggattgaaaggctgtttcaaaggaattagagctctgagactgcaacccanaaaacacacaatagcatatacacagagatgcacatagaaacatagacacacagggacacacaccagagatacacacacacacacacacggacaggcagacacanggccacaaacacat

SEQ ID NO: 109157 - DNA, 348 bp, Homo sapiens
  misc_feature (15)..(15): n is a, c, g, or t
cggccggataggcangatccccagatttttttgcacaaagttaggcaagcttggtggtatatacctgtagtcctagctatttgagaggctgagagcttgagaacaatgagctatggcttgagagagccagggtgacagagtgaggtcctgtctctaaaaaaatttttaaaattgtatttcgggttttaaaatagcggaaactagcagagttacttaatgaagtatgaggagttgattatagcacaattaaactaattattctaaatataaagcatatgacctttagataactttatgtcctatttttggtgtctactagcacaagcaaacaggatttgctttcttgga

SEQ ID NO: 109158 - DNA, 4599 bp, Homo sapiens
  misc_feature (1347)..(1347): n is a, c, g, or t
  misc_feature (2245)..(2245): n is a, c, g, or t
  misc_feature (3399)..(3399): n is a, c, g, or t
  misc_feature (3724)..(3724): n is a, c, g, or t
  misc_feature (3790)..(3790): n is a, c, g, or t
  misc_feature (4109)..(4109): n is a, c, g, or t
acaattcagtgtggacagtgcctggtggaaactattcagctttccaatcatctccaagtcccttgtgaatggttcgtccagagccaaaagcctgttgacaagctggagaaacacatgccgaagtacttaagacagaaactacgcgctgaattaaagccaaagacacggatcttcgaaatccagcccatttctggagtcttggatcctggtgagaagtccaacgtgcaagtgaaattcatgccaaaagaagagaaattctacagccaaaccctggtgtttcagattgcccagagtgctcaaaagcttaccctcctggcacgtgggcaaggtctagagccacgcctggaatttagtccttcagtcctggatctggggccactgctactttgtgcacctggagacgaggccgaggtgatagtgaagaatccctgcaacttccccattgagttttattccttagaatttgatcagcagtatctcatagaagaaaagatcttgcggaagctgaagggctatgattcctacaacaccctgctgctgcctccccgcaaccctggggagaagctgcccccagaactgtacgagtacttcaaagagataaagaagtcaaaagaggagcagatgagggcgaaatatctggagaatctggcacaggagaatgaagaggaagatataacctcatcagatcagggaacctccaatagcacaaagaggacatcgctgagccgagggatctctgtcacatccaacctggaagaatggcacgccctgttggtcgagtccaaaacctacctagaggaagaggaggatgaggaaagcctggaaaaaatcattttccaaactgacaagcttcagagcattgacagccactccatggaggaagttggagaggtggaaaacaacccagtgagcaaagcaatcgctcgccacctgggcattgacatttctgcagaaggccgcctggccaagaaccggaaaggcatcgccattatcattcacgggacacccttgtcaggaaagtcagccaatgccgttagcgtggccaagtactacaacgcagcctgcctgagcatcgactccattgtgctggaagctgtggccaacagcaacaacatcccagggatccgggcctgtgagctctgcatcagggctgccatagagcagtccatgaaggaaggagaggaggctgctgagtgactgctaccgaggagtggtgtttgatggcctcgacactctctttgctcggaatgctgcagccgccctcctctgcctgctgaaggccattggcagccgggagcatatatacattctcaacatggcccaggattacgcagccatgaaggcccnggagaaagccaaaaaggagcaagaagaacgcaagcacaagggagctcttgagaaagagaaggagggtctccaaaacatggatgaggaagaatatgatgccctgactgaggaggagaaactcacattcgatcgggggattcagcaggcgctccgcgagcggaagaagagggagcaggagaggctggcaaaggaaatgcaagaaaagaagctacagcaggagctggagcgacaaaaggaagaggatgagctgaaacggagggtcaaaaaaggaaagcagggacccattaaggaggagccccccatgaagaaatctcaagcagcaaacaagcagctactgtgtgctgaattcctgctatgtgacactccctgctgggaactgtgaatagatcccatcaccatctatctccagtctccacaacacccgctgagggagatatgatcatcaccatcattttggagatgaggaagctggaatgcagcacagttcctccgctcaccaaagtggatgtcaagatggagacaatcgaaaggaaaatatctgttagggaacaaacaatgtctgagaaggaagagctaaataagaagaaaaggaacatgggcgatgtcagcatgcatgggcttcctcttgtccaggaccaagaggacagtgaaggggacatctcaaaggaccccgacaagcaactggcccagaagtttaagacctatgaattgacactgaaggatgtccagaacatcctcatgtactgggaccggaagcaaggagtccagctgcctcctgcagggatggaggaagctccccatgagcccgacgaccagcgccaggtcccctcgggtgggcgcaggggccgcaaggaccgggagagagagcgcctggagaaggagcgcctggagagggagnaggcggagcgggagcgcctggagaagctgcgagccctggaggagcggagcgactgggagggggaaggggaggaggaccacgaagagaagaaggagaaggacctgggcgtacccttccttaacatccagacaccagactttgaaggcttgagctggaagcaggccctagagagcgacaggcttcccaaaggagagcaggctcaagaggagcagaccagctcatctaaggggggcaaacagaaaatgaaagaaaagatagaccaagtcttcgagagtcagaaagacaagcgtcacatggccttaaacaggaaggtcctttctggggaacctgctggaaccatttcccagctgtcagatacagacctggacaacttcaacgggcagcactcccaggagaaattcaccagactgaatcacttccggtggatcgtgccagccaatggcgaggtaacgttgcaggtgcacttctcttctgatgagttcgggaactttgaccaaacctttaactttgagatcctaggaacttgctgccagtaccagctctactgccgaggcatctgcacttacccatacatttgccaagacccaaaagtggtatttcctcagcggaagatggacatgaagacaaatgaggtcatctttaagaagtatgttatgagcacggagacgtactactttgggccactactttgtggaaaatcaagagataagtacaagtcatccttattcccaggcaacatggagacgctaacaatcctgaacacttccttaatggtggtggaggcatccttctattttcagaatgatgtcaaagcaaacacgtacttcctggaacccaacaccatggtcctgaaacccaatgagaagcagatattaaacgtatgggcctaccctacttcagttggtgtctttgaagacagcattgtctgctgcatcaatgacaacccagagccagccatcttccaattaagctgccaggggatccgcccggaactagagctggaacccaggcaattacattttgaccggctcttgctgcacagacaggaatccagggtagttcttctccgcaatgtcacgctcctgcctgtggcctggcggatcaccagcctggagcacttgggtgatgatttcactgtatccctgatgcagggnaccatcccccctgaggctgagtacggcctgcacctgtactttcagcccaccaagcctgtcaacatcaagaaggctattcggttggaggttttagatgcagaaaatcttcttggtgttgttcagattgaaaatatcatggtctttgcagaggcatacgacatcgccttggacatcaccttccccaaaggagctgaagggggactggattttgggattgtcagggtcacagaggaggcgaagcagcccctgcaattgaagaaccgtgggaaatatgagatcgcgttcaggtaactggaatcccatcagatgtaaggccatcaagtcngccgtgtggaggaatgtggggaaatatgagatcgtgttcaggtaacctgaatcccatagggtttgnggccgtcaagtccaccgtggggaatagcgtgtctgggaaacttatcagtcagtcaaggaaatcataagaaccgtctctgcttttttgcctcccttggcttcaaaagaatggaattccacctgctaaggaagcagagattctcacactgctctcaactctgcagcttaacagggccctttaagtggcccggatgtacctggccagttggaaccataggtgtctgggaatggaggaagagacttaggggaagaggccgggagggggagattctaggggtgagaagaggtcccagggtggagggagagactggagatgggcnacctggcctcaagctgtcctgccttctgccagctcttatctgctttacaaggagaccttcttcagcagatttcatgtgaagaaagggctttcctttttcattacattctaagaatcacgatattgtacaatccaaatagtagcttggtagaatagagctctggcttgtgctcatccccagagataaaaaatgaaacacagaggctgggtgtgatggctcatgcctgtaatcccagcactgtaggaggtgaaggcaggcagattgcttgagcccaggagttggagaccagcctgagcaaagtggcaagacccccctgcctctacaaaatacaaaaaaagttagctaggcgtggtggtcatatcacttgtagtcccatctacttgggagactggaatgggaggatcgcttgagcccagagaggtcaaggctgcagtgagccgtgatcgtgccactgcactccagcctcagcaacagagcgagaccctgtctc

SEQ ID NO: 109159 - DNA, 804 bp, Homo sapiens
ggtgcagcgggcccttggcgggggactctgagggaggagctggggacggcgaccctaggagaggttttagatgcagaaaatcttcttggtgttgttcagattgaaaatatcatggtctttgcagaggcatacgacatcgccttggacatcaccttccccaaaggagctgaagggggactggattttgggattgtcagggtcacagaggaggcgaagcagcccctgcaattgaagaaccgtgggaaatatgagatcgcgttcagcttttccgtggactctgtagggatttcaacacctaatataaattccatgatctcagtccaacccaaaaagggttcactgaccccaacagaaaaacccagaaatgtccaagttttcttccatgcaaaaaaggaagtgaagattgagcaccagcctgttctgcgctgtcagattattgagcccaatatttcagaaggaggtgagatcattgccagcatcccaattaagttttccgcgaatgcagtatattccaaatacaacatcaccccctcctctgtcatcaactttggagctttgatctgtggcactcgtaaaagcaccaccttcaccatagaaaatcaaggtgttactgacttcaagttcgccctttataagctgacaggggagagccccattcatcaaaagaaagcagccagccacgtcagacatgcaagatcccgagaaagtgagagcttctacaaaactggctcttccagagcagccaagttctctgacacgattcagaaagaagtaaccaccacaggccaggtgcgtgtccttttc

SEQ ID NO: 109160 - DNA, 721 bp, Homo sapiens
catggagaaaccctgtctctactaaaaatatgaaattagccagggtggtggcacatgcctgtaatcccagctactcgggaggctgaggcaggagaattgcttgaacccgggaggcggaggttgcggtgagccgagctggcgccattgtactccggcctgggcaacaagagcgaaagtccgtctcaaaaaaaaaaaaaaaaaaaaaaaaggtataataaaaatttacttctaaagatattcataaaagcattatttatgatagtaaaaaattgtgtgcaacctaaatgttcagcaaaataagacaagttaactaacgtatgatgcatctatacaatataatgttaggtagccaattaaaaatcaagttttaggctgggcatggtggctcacctgtaatcccagtactttgggaggctgaggtaagaggatcgcttgggcctgagaggtcaaggctgcagtgagctgtgatcatgccattggactccagcctcggtgacagagtgagaccctgtctcaaaaaagtaaaataataaaataaaataataaaaaaattatgtttaaaaaacatttaagaccatgagaaaatgctcaaaatagaataagtgaaaaaaaaagcatgattctacagttattatctctgggtaccaggactactactaatgtttatttttttctttttaacttgtatttattttctgaaatctctgtagtgaattgcatt

SEQ ID NO: 109161 - DNA, 787 bp, Homo sapiens
ttgaagattgcacatttgcctctttttttttttgaaagaagcataactttgacctcaggaaagaatctcagcctttttcctgaattttttattctaggttccattcagtaagagcattcattacctgcatttgagtatgtaatagataaaaccaaatttttaacattttcttaaatataggtgtcaagaaaataatcagaatccattgcatatgtcaatttttaattagatcattaatttatgttctataagaagtctcttgaatactctttggagtatgaagtattaattatgtgtcttagttaaaatttgtggttgctgtgataatactgtgtagataggtatgtcagtaatacagatcttctgaattgttcttgcttatacaaaatacaaatataacatcaatatctgtgtctgataatattgtctttattttttaatccttttattacctgattttttgccaaatttctacattaaatacgttattttgaatttaagagacagtgagtagaattcaagaaatcatttctgaaattaaatacatcatcacattttgtaactctgctgtatgtatcatgcaagccattgaacagatccagttttttgctgtctagaaatttcaagagcagtgcttgatatgaacaaataaatgctgttagggtctaaagacctgatcccttacgaaaccttgaatattaacaccaacattttttgtgtctatatcattaggttataatgtgtagtagaacagggcagttgggtaaggattagtgaaactttttta

SEQ ID NO: 109162 - DNA, 233 bp, Homo sapiens
tatggatagggcacttgggaagcagtgtttgctacccttctagaggagcagcaggcatctgtaatttttcagccttccatggacacctgttttagctgattcattctcataccttatctttctgtattttgagtttgagacagttggaaatattgctagttgttttcattatttgtttatttttccagataccttatttggtttccatttacactaacacttaagctttgacc

SEQ ID NO: 109163 - DNA, 460 bp, Homo sapiens
ttacggctggaggaacttccatcctcaatgtctccagcgctgcaacacacctggaggctttctgcttcactactgcctcttggccgtcacgcaaggtattgtagttaatggcctagtaaatattagcatttccactgttgagaagcgttatgaaatgaagagttccctgactggcctgatttcatcaagctacgatatttcattctgtttgttgtctttatttgtatcattctttggtgaaagaggacataagccgagatggcttgcatttgcagcctttatgattggactgggagcacttgtattctcattgccacaatttttcagtggagaatataaattggggtctctttttgaagacacttgtgtaacaacaaggaatagcaccagttgtacatcttcaacttcttcactttctaactacttgtatgtcttcatcttgggacaactattgctgggg

SEQ ID NO: 109164 - DNA, 202 bp, Homo sapiens
aacccctgggtgttcacaaaaggggaagtccaggaccacccacgcactgctcaactcctgccatgccagaggggaaaggtgaggtatcggggggttttcgggaggagtcccttcttctgtctgcttcttccacaccccacacccagtggggggaacaagcaggcctccattcatgaactcaacaagaaagtcagcctggcgt

SEQ ID NO: 109165 - DNA, 346 bp, Homo sapiens
aagatgtcaggcttgtaaggaaaaatacatttttgcttttttaaaaaaaaaacttgaaagcaatttgttgaaagataaaaagagctttacataagcttatgtggaagcggtcggaaagggttccgtgtatcatttagagacaaacttctggaacattcctcaggctgaaaggcctcagatctcatcattgtccttatggatgtgtcagagtttgagacaatctctttcagactgaaagcattctctttaagagttttgaaggaagagcctgtaatcccagcactttgggaggctgaggcaggcagatcacaaggtcaggagatcaagaccatcctggccaacatgg

SEQ ID NO: 109166 - DNA, 2054 bp, Homo sapiens
agagagttctggacagcagagactacagattgggtcatagttttgcccagagccttcccactgatccatatggtggggtcctcacgttcctcttcctccagcattcaccatagccacacaaagctgagtagccccttccttttatacctttaacattcattaactcagacttctgagggaccacctctgtggcagtggggcagtgatgtgttggtgaaggcacaagaccaggaaactggtttgactctgggatctatgaccttgggcaaatcatgcccctcccttcccgtcgggcttcagcctcatactctgtaaagtaaaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagaggtgcaggggcccgggctgggacagtgaagagtgctgggcagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacaaaaaaa

SEQ ID NO: 109167 - DNA, 1922 bp, Homo sapiens
agagagttctggacagcagagactacagattgggtcatagttttgcccagagccttcccactgatccatatggtggggtcctcacgttcctcttcctccagcattcaccatagccacacaaagctgagtagccccttccttttatacctttaacattcattaactcagacttctgagggaccacctctgtggcagtggggcagtgatgtgttggtgaaggcacaagaccaggaaactggtttgactctgggatctatgaccttgggcaaatcatgcccctcccttcccgtcgggcttcagcctcatactctgtaaagtaaaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagaggtgcaggggcccgggctgggacagtgaagagtgctgggcagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagctgccatcttatgcttcctgcggacagccctgcgacaaagcttttcctctgccctggtagccctggtgccctcaggggcccagccactgccagccaccaaggacactgtcctagctccactgcgaatgtcgcaagtccggtccctggtcattgggctgcagaacctcctggtgcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacaaaaaaa

SEQ ID NO: 109168 - DNA, 1839 bp, Homo sapiens
agagagttctggacagcagagactacagattgggtcatagttttgcccagagccttcccactgatccatatggtggggtcctcacgttcctcttcctccagcattcaccatagccacacaaagctgagtagccccttccttttatacctttaacattcattaactcagacttctgagggaccacctctgtggcagtggggcagtgatgtgttggtgaaggcacaagaccaggaaactggtttgactctgggatctatgaccttgggcaaatcatgcccctcccttcccgtcgggcttcagcctcatactctgtaaagtaaaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagaggtgcaggggcccgggctgggacagtgaagagtgctgggcagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacaaaaaaa

SEQ ID NO: 109169 - DNA, 1401 bp, Homo sapiens
agagagttctggacagcagagactacagattgggtcatagttttgcccagagccttcccactgatccatatggtggggtcctcacgttcctcttcctccagcattcaccatagccacacaaagctgagtagccccttccttttatacctttaacattcattaactcagacttctgagggaccacctctgtggcagtggggcagtgatgtgttggtgaaggcacaagaccaggaaactggtttgactctgggatctatgaccttgggcaaatcatgcccctcccttcccgtcgggcttcagcctcatactctgtaaagtaaaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagaggtgcaggggcccgggctgggacagtgaagagtgctgggcagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcagaaggaccctctattgtcccaggcctgtgttggctgcctggaggccttgcttgactacctggatgcccggagcccagacattggtagaaactctccacattatctgatgttcccatgagagagattagagggagcaacacccttccaccctcctgctccagccttccattcccttgtgtgactcatacttgttttgtttaattcttttagcagcactgcaagggcagtcatgcccattatacagatg

SEQ ID NO: 109170 - DNA, 1878 bp, Homo sapiens
agagagttctggacagcagagactacagattgggtcatagttttgcccagagccttcccactgatccatatggtggggtcctcacgttcctcttcctccagcattcaccatagccacacaaagctgagtagccccttccttttatacctttaacattcattaactcagacttctgagggaccacctctgtggcagtggggcagtgatgtgttggtgaaggcacaagaccaggaaactggtttgactctgggatctatgaccttgggcaaatcatgcccctcccttcccgtcgggcttcagcctcatactctgtaaagtaaaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagaggtgcaggggcccgggctgggacagtgaagagtgctgggcagtctgtggtcctctgtatctcaactttttcatcttaaaaaaacaaatagggttgtgtgtgtggctggtggtcataaggtcctttctggctctaataacctgagcttctgttatgaagctgggacccttagagcctcaggatgatcctctgtttgtttgtgaagccccaatcaggtgctaagcaccatagtggcacttagctgaagctcctctgtaactcctgtgggccctgccttgcccacccccgacagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacaaaaaaa

SEQ ID NO: 109171 - DNA, 1588 bp, Homo sapiens
agagagttctggacagcagagactacagattgggtcatagttttgcccagagccttcccactgatccatatggtggggtcctcacgttcctcttcctccagcattcaccatagccacacaaagctgagtagccccttccttttatacctttaacattcattaactcagacttctgagggaccacctctgtggcagtggggcagtgatgtgttggtgaaggcacaagaccaggaaactggtttgactctgggatctatgaccttgggcaaatcatgcccctcccttcccgtcgggcttcagcctcatactctgtaaagtaaaggacctcatctattccagcccagtggacacagctcacaaggtactgattagcctgaggaccttcctgaggaggaatgaggatatccaagtgggcggtcttatccgaggccacttcctgctgatcctgcagcgtctgctagtggagcatggggcatccccatcaggagcctcggggaacctaccattgctgctgagcctcctctccctgatgcagctcaggaatgtgtcagagcaagaactggacagcgtggccatgaagctccttcaccaagtaagcaagctgtgtgggaagtgcagccccactgacgtggacatcctgcagccctccttcaacttcctgtattggagccttcatcagaccacacccagcagtcagaaaagagctgctgcagtgctcctgagcagcacaggcctgatggagcttctggagaagatgctggccctcaccttggcaaaggcagattctcccaggactgcactcctctgctctgcctggctgctcactgcctccttctctgcccagcagcacaagggcagtttgcaggttcaccagacactctctgtggaaatggaccaagtattgaaggctctcagctttccaaagaaaaaggctgcactactctcagaaggaccctctattgtcccaggcctgtgttggctgcctggaggccttgcttgactacctggatgcccggagcccagacattgctctccacgtggcctcccagccttggaatcggtttttgctgtttaccctcttggatgctggagagaattccttcctcagacctgagattttgaggctcatgaccctgtttatgcggtaccggagtagcagtgtcctctctcatgaagaggtgggtgatgttctgcaaggtgtggctttggctgacctgtctaccctctcgaacaccacactccaggccctgcatggcttcttccagcagctccagagcatgggacacctggctgaccacagcatggcccagaccctgcaggcctccttggagggccttccccctagcacctcctcaggccagccacccctgcaggacatgctctgcctgggaggggtggctgtatccctgtcccacatcagaaactgatcctcaggacttgaaggcccagaagtggagagagaatgagacctggagacaaagggcataattgttggggaaatggatgacagctgaagctattcatatggagccatatactctattgttgaaatagaataaggaaataaaatgatacactcacaaaaaaa

SEQ ID NO: 109172 - DNA, 298 bp, Homo sapiens
  misc_feature (28)..(28): n is a, c, g, or t
tgatctagaggatcccttagatccaagngcctagatgttctctggccctctagagactcaggaagggggtcatctgtgtttgggggctgttgtgcctcctggacctgagctgggtaatttgggacatctcctccttgcaacttgagtcctacaggggtttgcagaaggttgcttcccttgaccatccctcccagcaccccaggcactttcagctcacaggctgtagctctgggcctccagtcattcataagtggctgcgaggcctctgccacagcggaggtgcggggtggaggggggg

SEQ ID NO: 109173 - DNA, 361 bp, Homo sapiens
tttgctctctgagaaatactattctaggactataaaccacccatttttcaatttactgtaatttagtgtttcatacactaaaatggacactaaaatctgtcattattactgaccaggctatgatcacacctactcagtcataccagagctgtagattctgactctgagagcttagttatctaattttgttttttaggctcaagaagtaatagttggtcttatgtttgttcatttttagtaaaaagaaaaattcagaaaatgaacactcccacacatttgtgcttttggcacattaagtatgtactctgtgaactgtatcatttaaatatttttactttaacactgtagatgtcataacaca

SEQ ID NO: 109174 - DNA, 112 bp, Homo sapiens
gctgtgtggaaagagctacctggacagaaaagcctgaagaatcagaagaaagggcaactgatggtgcagggactggtctcagacaagtaaggggtcatttcaccctatgaag

SEQ ID NO: 109175 - DNA, 305 bp, Homo sapiens
gttaggatgttatagcacagggctagactggggtagtacagtaaaaatggagaagaagaggtgtctgcaagaggtgtcatcatggaaaattcaaaggattttgcctgcctctattttttttaatgagacgaagtcctgctctgtcacccaggctggagtacagtggagcgatctcaactcacagcaacctccatcttctgggttcaggtgattctccttcctcagcctcctgagtagctgggattacaggcacgtgccaccacgcctggctaatttttgtatttttagtagagatggtgtttcac

SEQ ID NO: 109176 - DNA, 495 bp, Homo sapiens
cagatatttaaatactgaaaaactgaattcccatcattttaaatattttaaatatacttcactcactctaaagaagcctgccaaattaaatgtatctgtgatactctaaaaaatcttgttactttggaccttcaggttaataaacccaaaggtaactttatacctgcgtaatgccagcataactgtcctgagagaggggacctagtattctgaagataataatgttttaaaataatttatgaaaaaaatactcttttaagactacatcaataggatgtaaaaactttcaaaaatacgaaacttttaaaaacatttataagtatgtcacatgaacgctggtatcatagtcttcacctttattttaagccagtatatacatgaggagtcaggctccaaatcacaatcctatgtgtgatctctcaggcccaaccgttgataatttcaagacgttgggtggcaagactatttaaggaaatctgtcctccatacacaaat

SEQ ID NO: 109177 - DNA, 130 bp, Homo sapiens
actttggtgagcacttcttaaatttaattttcatcataatccatgaggtagtttaccctagatcaggaaatgaatgcttagaaaagtttaataacttgccctagaccacacaagcaaaatggcaagatct

SEQ ID NO: 109178 - DNA, 733 bp, Homo sapiens
aaagggaagagtggagtaattaacagcccagcctcaagacaggggccacctcccagctgtgtgaccccaggcaggccacctcttctctccagcttcagtttctttatctgtaaaatggggccaatttatagcacctgcttcttagggctcttgtgaggatgaaatggactaatccatgcaaattttagcacagtgcctggcacagagtcagcctttgtgagtctgctgttactatatatcctggtatggtctgcagacaaacttaaagaacataaaagcttcacaatttgaaaaggaacagcctacatggataacctcttccattgaaaaaccatgaatttgttccttctgttttcttctccctactggctctttttgtgagaagttgtcttaaaacttaactaaaattacaaggctccttaagaactgcctgaaaaaaataattatggccaagtgtggtgattcacacctgtaatcccagcactttgggaggcctagacaggaggatcactggagcccaagagttcgagactagcctgagcaacatagtgagacccgccccccacctcccctcaaccatctctactaaaaataaaaaaaaattaggagggtgttgtggtgcatgcctgcagtctcagatactcaggagatggaaggaggaggatggcttgagcccaggagttggaggctgcagcgagccgtgatcatgccactacactccagcccaggcaac

SEQ ID NO: 109179 - DNA, 354 bp, Homo sapiens
  misc_feature (348)..(348): n is a, c, g, or t
gcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctgtgccataccagttaaacaggctgattctggaagttctgaggaaaagcagctttacaacaaatacccagatgctgtggccacatgggttaaaccctgnacccat

SEQ ID NO: 109180 - DNA, 378 bp, Homo sapiens
tagaatgtgtatgtctccttgtaagaatccaatttgaggggttcagaaacacatagtgaatatgcctgatgagtagtgatttttcaataatgatttttacatgttatgtctcctcaaagataacaacagagcaccatgttgcctaaattcatgtaacttccttctgggttaaactgtttattggacatttctgaatatatgcaccatatgtggctatctttcaaagtatgtgtctgagatattattcagagccttttccagccatttagagatatatgtggagcttagagagaataaaaatataatgtgcattatttactagtaattcacataaaatattccatttctaaagcatgttgcagaattattctactggta

SEQ ID NO: 109181 - DNA, 788 bp, Homo sapiens
gctcgtgccggcgtcagggtccccctgccatctggagtgagcaggaggcggccaggccaggccttcccagctgaggtttgggagttccgtgcctttggtgctgagggtgagcgtgttcacggtgacttcgtcccttggtcatgaggaggttcgagctaggaaccccctgcaagtggtcaacgcatccggcttgctgttctaagtggaggcggcaggcacagctgggacccacgcccctcagaagcaggctctgtggtggtcggagcaggcacctcaccaggccacgctccatttggggctgctgagaagctggctgtggccagtcctgaggtctctgcagccctcgggagcttggaggcccggctggtttttctaaggagttggccgggtggccatggctgcccacagtggggtgtgaccttgggcttgtggcctcctcagtgagggcctcctggcaggggctgagagcccagcgtcagtggggggcttcagcatagaccaccacatgtgtgtctctgggtgcttggtaaatgcaccctgtgcttcggtgacaagtttttttgtctagtcaagtgaagcagtggaaatgcagggagcatcttaaatctgttttatttctaactgatttcaattccacctttacccttaggccgaccaagcatctgaggtgccgggacagtaccaccttgccatggggcttcaggcctgctgtgaccccttggggaaagtgagccccatggccacctgcccagttcccaggtcttgtgctgtcagaattcctggtgggc

SEQ ID NO: 109182 - DNA, 481 bp, Homo sapiens
tcctcttcccttcccttaacatctcagaggcctttgtacttgcctcaacaaatcgccacaaaatatgtgatggaagtgatgctgcttctaggacttctgcaagtttctctcggcacactggcctgggagccttcagctgccaggtaagaagtccaaccacccttagagaccacatggagagaacatagagggagatggctgagaggctccaaccattctagccagcagctgcttgactcttttcagctcagacagcagatgtgtgagctctctttgagattatgactctagcccagctgctgtcagaccacagctgcaggagaccctgagcaagaactgctttgccaagtccagtcacccccagatctgtgagcaaaataaatgaccatgattgtttcaagctgctgttttggggtggcttattatgcagcaatagataactagataactgaaacagttcccaacacagagcactgttaat

SEQ ID NO: 109183 - DNA, 233 bp, Homo sapiens
tcctcaggacagggttcagagctaggctggtggctgctacacagagacagcaccctccaccagttaaggtataagacaaggtataaggctgatgggctgtaggcatcaaacctggaactcacagtcggggcacctcacttcaagccttggtggataggtaagatgaacactcaggctcccaagttagacagatgagctggatccttcatctaccaccaatttcctggctgtgt

SEQ ID NO: 109184 - DNA, 698 bp, Homo sapiens
gcagaagcaagagagagagtggggtggtgcaacacactattaaacaaccagatctgaagggaactcatgcactatcatgagaacagcaccaaggggatgatgcgaaaccattcatgagaaatccaccaccatgatacaatcccctcccactagggacccctccaacactggggattacaatttgcatgagatttgggtgaggacacagatccaaaccatatcatgcttcataaatcaaaagtttacaaacgcaatggactattgccaataagtatatttctttatccatcatgctacatttagtatatatactacttataaataaatgttccccccaaatcacattatctaaagtcgcaggctttagatcgcagcctttatcctgtcttctagaacactgataatggtgagaaatgttattggcatgttttattgtttactggaacaaactatgtgttgttctagggcatgaaccaaaggccctttttgcaagactggctcaataaattcttccatttaaaaagaaaagaaattcaaaatcctcattttggcctggctctgcaattgaaatgagcagtttaaaccaattcaatatctggcccagatgagcaatttaagccagttcaacatctgccaaataatccaatattggtaatcaaatagttgtgctaaaccaaggaacaaagcttgctcttggc

SEQ ID NO: 109185 - DNA, 454 bp, Homo sapiens
tgtgagtgacacgatagaaactaactctgtatttcccctagggccaaagactcaccattcactaattcagtgtttgaggtgactttaaagcccttaactataccacaaataaggagaatcactccacttgttcttggtcaccaaattccttgctatccacctgcccccaaattgttttcattctttttttaaccagctcaatttagatacaatacattgagcacagtaaactgcacatatttaaaatgtgcaaacggatgcattttgacatatgtgaaaccatcatcaagtaaccaaggtaatgaaaatattcatcacttcccacacttcccagtgcccctttgcagttcttccttcccaccctttcactggtctgttttctctcagtatagattgcttgcatttcctagagtgttgcataaaggaatcaatttattttatctggcccctggct

SEQ ID NO: 109186 - DNA, 455 bp, Homo sapiens
tgtgagtgacacgatagaaactaactctgtatttcccctagggccaaagactcaccattcactaattcagtgtttgaggtgactttaaagcccttaactataccacaaataaggagaatcactccacttgttcttggtcaccaaattccttgctatccacctgcccccaaattgttttcattctttttttaaccagctcaatttagatacaatacattgagcacagtaaactgcacatatttaaaatgtgcaaacggatgcattttgacatatgtgaaaccatcatcaagtaaccaaggtaatgaaaatattcatcacttcccacagaagtcaccctgtgtactggttggttatttccaacctggtttgaaaagtaaagaagttgcactgaggggtaagtagaactgattgaaatctaggtgcctgtgctgtcctgctcttcccttatgacgttt

SEQ ID NO: 109187 - DNA, 456 bp, Homo sapiens
gttagtcctttgatgtgtctttaggcaattccactaactccatggctattttgagatgaaccactttttatgcatcatttttgccatcttccatttttaatgctacatacgttctgggcttatagtttgtctattcataaattactcttagtaatcttgtgttccacgcttcttgcatattatttgttaacaagatagacagggccattcctatctgttactgtcctcaaaattctactcttattttggattatactatgtataaagattttaaatctgtgaatgtccagtggggtcataacataattactaaccagtctggttagtgttgaactcttacctagttttcctgaatcttaaatacaaattgcttagtagctatacaagggtgttttgaaactaatggatgtttaaaggaccatggaccattcagtctttgtagaacttctaaatgta

SEQ ID NO: 109188 - DNA, 315 bp, Homo sapiens
tatctggaaacagagctggtcattttctttttctgtatctcagccaaggggaggggaaaaggttggttagagagaaggagggaggtcaggagatggaaaatgggatgagatcctgttactttcaatcccctataatttgttagtgtttaacagagacagttacattaagcaggaaatccaattcagtttcccagtcagcatgcttgtactgtttcaactaatgctctggatgctccaaagaaaatgcaaactagcatattaattatgacaacattcacatttcattccttcaaaataagcaataaagaaacaaat

SEQ ID NO: 109189 - DNA, 258 bp, Homo sapiens
tggaatctaatcaaattttacaagaaatacagaggatagaaagaaaagctaaggaacatcacaagaaagcaatcaaatccataaatatatgtccataagataataaataaaagttggtatgtcttccaatggaatcctatatgatagctaaatgaattggatttgtatacagaacatcaatttaactctcagaaataaaacgttgagtataaacaagttacataatgatatatgtataaattatcatttataaaaatt

SEQ ID NO: 109190 - DNA, 540 bp, Homo sapiens
agagatggggtgttctatgttgcccagtgtggtctcaaactcttgggctcaagagatcctcccacttctgctgcccaaagtgctaggattacaggcatgagccaccgcgccgggacagttattttgtagagtgttctttaatttggatgtacctcatcttttatgtatctttgggaggaataccacataactcatgtggtttatcccatcgagagacacacagtgtcaatgtgttccattcttggtgatgttaacttttattacttagtgaaaataattctaagagatttcaccactgtagagtgaataaatgaatatgtgggattcatcaatgaataagtaaaaggatgccaactggcaaaagaactgagttgggaggatggcttgagcctgggaggtcgaggctgcagtgagccgtgatggcaccactgccctccagcctgggtgacaaagcaagaccccgtctcagaaaaaattaaataaataaataaatacccagcacctgaacatctcgggcatttcctgtgcctcttatattgg

SEQ ID NO: 109191 - DNA, 315 bp, Homo sapiens
ctccccctcctcacacctggtccagcttacagtttcgttctgcgactggccctcccccacctgcccagcaatttcctcttaaaaaggtggctggagctaaaggcatagtaaaggttaatgctcctttttctttatcggacctctcccaaatcagttagcgtttaggctctttttcatcaaatatgaaaaacccagcccagttcatggcccatttagcagcaacccttaagactctttacagccctagaccctgaagggtcagaaggccatctcattctaattatgcattttaacacccagtcagctcctgacatt

SEQ ID NO: 109192 - DNA, 347 bp, Homo sapiens
ctttcttgacctgggttaataggtaactggatgttaatcattatttttttaaaccacaagtgcattttggccatttttctgtgtaaaatacatttcataaaaatgtttaatgtacatgaatctgagataagatacaaatcaatccaaatctagttgtttaaaagaaatgagactcaaacagaactgcactgcacctggtttcatttttacatgacattttagaataaaaatttcaaactctaagtctatcccttagatagcaaagaaaaaacaggttgtagtttgcaaatacattactgaaaaggattttctatagtttttcaaatcatttcagttgcaaaatcagt

SEQ ID NO: 109193 - DNA, 629 bp, Homo sapiens
tgttatccatctgaaggttttccagttacacattgtaaggtacaatgtgtaccttacagatgtaaggtacatctgaaatagtccaaattactgactcaggccaatcacatatgctttgatttttctgtgacctaatctttttctcaaaatgaccctggtcctcaatgcgttgtcttcatagtctaataaacatctacctcccagttcttgttctgaaaatctttttcttattttactaccaacagaaaactgtttatataactgctttgggtctaattataaagttaatctgattcattgaaaatacaactttttttctcatctctcaaccattatgacttgcaacacggacatttaagtcaagtctgaggagtctggatgttggtctatagggaatgttaaccaatgaaaggctctaagtaaagggtcgcttcaggtatgcttcagagtaatcaatctggcctcacagaggaaaaggattagagtaaatgagcaggaaccagggagccagaggccaactggggagactaccgtctggctgaggagtaattaagacctaaagcagggcaatagctgtgggagcagagacattggcagaatgtagccacatcatctgtttcaaaatccca

SEQ ID NO: 109194 - DNA, 616 bp, Homo sapiens
ctctaaaaacagctagaggagatgtctgcttattataactggcctctgccaaaggcttacttttaattgttatagagccaggtcagttattcctttgactgtggaaataataagatggttataaaatgcagctttggtatggtttccttgcaagaagttcacattttctatcaagaaaataattctgtgtgtatggaagtgtgtgcctaagagtttttgagtgcagataaaattgttttgatgcctgaattctcacaaagtttagccaaaatatccaggtacttccaggctactgtcaatattgggattgctccttctcattcctccatgtggcaggacttttaaagaggaaaaaaggactgagtttagagtgctgaaataacagcccgattataatttttgtcaatttaccacttggacgtttattctctccttccctatatattccaactccttgctctttttgcattgtaaaatatagtatttttaggattatacaccatatgctaatcttttacccactcttcagtatcacaactttctttctctgtggggaggaaaaatccctgtcccctttctgtcttcttgccttttgattctatttgccatagtctaa

SEQ ID NO: 109195 - DNA, 607 bp, Homo sapiens
attactggggtgagggtggagaagcgggggcggtttgctaaatggatgtgctccatagccacaataaaacgccaccaagcccttttagcccctcattagctagaccctaatctggggtggtgccagccagagcgggtgcaccccctcctccagcccgaggtggggcagtgtcagccccaagcctcaccctcctcacagggacgcttccgcctggccctgccctcacccactcagctggtcgactccgtggtttccaacacaaacacattctctggatttcaggcgcacctcaatctctccacttgaggggcagaggaggctccaggctatgtggccagccctctgcctcctactcgactccctggctccccatgggatggaggtggtgagatccaaaaaccctcagtgggaaaacaggttctgcaccttcctgccacctccacgcctctccctgggctgtagtcttggcatttgccaaggcccccgtgggcatccacgccctgttttccccagaagggtctcccctcattccctgcaaaccagcagggcatctccaggtggaaagaaggggagggcttgggaggcagatggaggttcaaggtctagt

SEQ ID NO: 109196 - DNA, 216 bp, Homo sapiens
accacggtattgcagcgtttgctacaagagcagcttcgctatggcaatcctagtgagaatcgcagcctgcttgccatacaccagcaagccacagggaatggccctcctttccccagtggcagtgggaacccgggccctcagagtgatgtgttgagtccccaagaccaccaccaacagcttgtggctcatgctgctcgacaagaaccccaggggcag

SEQ ID NO: 109197 - DNA, 692 bp, Homo sapiens
gtcaccaccgggacgcccctcatccatctctatgaccgggcagacggaacccaggagcccaggagattgacggcaacacacacacacacacaagattggaaggatagacactgaaaagtgacctctggcctcatccgtgattttatttatttctttaaaatttttacagtaacatacctggtgtttgagatacttttctaaaaaatcaattttttaatacctaccactcaaaaggccatgaatattgaatgggctttgcacaatgcccaggcaaaagcaacaacagcaaacgaagaaacaatgtgcactccaacacttggtgaaatctgcttgatgatttgagaagtgataaaaatagattttgtgattacaatagcttttgaagctaaagctttgcacatgacagagctttcatgctagtggcccacagcactgggttgagtcatttactaaatggaaaaaaatgattgaaaaattaatgttgggctttatttctgaagtctcattgacaagaagaaaataacaaagctgtttttcattttgtttatcctgaaagtcttcaacaagtgattactcaaagttcttagagcagttgtttctcttctatgctgtctagatctccagatcacactaagtttgtgggaagcttcaaaaccaaacaagacttcacgccaggttgtcccaatccgacg

SEQ ID NO: 109198 - DNA, 2518 bp, Homo sapiens
gagatcgcccaccagattgcctggtataaatgacactgtgagagagcagaggaagacacaaggagtcctactcgggctcggtgacagtctggggtgggttaaagcggaggcctgggagagggaccaaggccactccaggcagcatccctggatctcagcgaggccgctccaggcagcaggatttgaccagagcaaggaggaaggccaaggcggccaggacggatgcagcatccctgaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaattttttttttttttttgagaccgagtcactcttgtcacccaggctggagtgcagtggcgcgatctcggctcactgcaagctccacctcctgggttcatgccattctcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcctaagtcaaaaaaagttg

SEQ ID NO: 109199 - DNA, 1117 bp, Homo sapiens
gcaccaccccgcctcccccccccccacccgccgccaccaccgccaacctacgctaggtacgatgcctgggtgttactgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaaca

SEQ ID NO: 109200 - DNA, 2598 bp, Homo sapiens
gcaccaccccgcctcccccccccccacccgccgccaccaccgccaacctacgctaggtacgatgcctgggtgttactgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaattttttttttttttttgagaccgagtcactcttgtcacccaggctggagtgcagtggcgcgatctcggctcactgcaagctccacctcctgggttcatgccattctcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcctaagtcaaaaaaagttg

SEQ ID NO: 109201 - DNA, 2544 bp, Homo sapiens
gcaccaccccgcctcccccccccccacccgccgccaccaccgccaacctacgctaggtacgatgcctgggtgttactgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagttattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcacacacacacacacacacacccccacacccctttgccggttcctcgactcatacatccctcgtgctttcccatctccagtctgtattactgtaggttctcttcaaataattaattgagcagacaagtttgttttattttggagcctttttggctctggcttttaaacattgtcctggttggctcatttaattttttttttttttttgagaccgagtcactcttgtcacccaggctggagtgcagtggcgcgatctcggctcactgcaagctccacctcctgggttcatgccattctcctgcttcagcctcctgagtagctgggactacaggcgcccgccaccatgcccagctaattttttgtatttttatagaggcgcagtttcaccgtgttagccaagatggtctcgatctcctgacctcgtgatctgccctcctcagcctcccaggtgctgggattataggcgtgagccaccgcgcgcaccccatttaattattttttatgttataaaatttaatatggaaagtgagaatttgaaccttcaccatccaccactctattcaggtaaaacaatgaatgagccaccttagcaggagcagatttttcccagaagctgctgcctcttcctgaggcagaaaattggattactaaggctcaaaactaaaagagatgtcagcattgttggatagaaatgtcacctatatgggatttgcctgttttaataactttgtaaggaattcttgctcttctaggggtgcctggcgcaaccgtgggcaagttactgctcctctttaaacctcgtggtggttattgaaacagatttattagaaggagagggtaggtgcagagctggagagccatgggtgaggcagcttgtgacctgcctagcagccgctgaccacctctccaacagaagcctagtcctgttcagagcagcactgtcactgcaagtccagccccctttgccaggggctccattccacccctttcctgcagggaggggtgccatgagtcttgcttttggctcatacaggagagagggaaggctgccaggcactgcttgtatccctgctgataagaggagggagtcactccaggaataagacaaaaggagaggaggaggccatcacctctggcctcttccatcgtacacttcctgtctctggtttaatcatgatgcatggagctacaacagccatcttaggtccccgaggtgcccagcatcacgtaaaacatcgatatgctaagaagaacaaaaagagcccaatctctgatgttattgagctcctgcatgaactctggacctgcctgcctcagacttctgtgaaagaataaaatttctttttgcctaagtcaaaaaaagttg

SEQ ID NO: 109202 - DNA, 1316 bp, Homo sapiens
gcaccaccccgcctcccccccccccacccgccgccaccaccgccaacctacgctaggtacgatgcctgggtgttactgttgagcgggggccgaccgacggccaggagtttcttttctgcgcttgtgcgttttctgttcggtttccttcccgctagcggggccacgagggttgctaggcaacagcccctgggtgacttggtcttagggtcctgtccggcttggggctgatgaaaggagctgtccgcgcccgggctcttccgagaagtggttgctgacagccacaaagtgaaagggagtgaggcggcgtggacgagtaaggagtgacagtgaggattcacatttgggttatttcaagatgagcttcctactgcccaagctgactagcaaaaaggaagtagaccaggcgataaaaagtactgctgagaaggtgttggttctcaggtttgggagagatgaagatcctgtctgtctgcagctagatgatattctttctaagacctcttctgacttaagtaaaatggctgctatatacctggtagatgtggaccaaactgcagtttatacacagtattttgacatcagttatattccatctactgtctttttcttcaatgggcagcatatgaaagtggattatggatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtttttctttatccctttaatacagaaccctcccaaacattggctagtacaacttgatttcatcatgttcatttgatacacaagtgaactggaaagtcacttcccatagaagcaaaagtacttattttctaccctagctgggtgcatgtgtgtgcgctctttcacactcaggaaacagctctgcccactatgccggtctcgacttaccttggtttatcctctagagtcagctagaaga

SEQ ID NO: 109203 - DNA, 400 bp, Homo sapiens
aagagtctgttcagttagttaccctcctcttcaatatcattcgcttgtcaggtagggcaggaaaagttgctgagaatattaggtagcagtttctccccttccattgtcccttaaaatacttttcatgctctttcatggattatctggggttttggccactctagaaaatctttggaagcagctgcgcatagtggctcatgcttgtaatcccagagctttgggaggttcacttgaggccaagagtttgagaccagcctgggcactatagtgagaccctgtctctacaaaaaaaaaaattaaataaaaaattagctgggcatggtggcatatacctgtggtcccagctacttgggaggatgaggtgggaggatcccttgagcccaggagttcgaggctacag

SEQ ID NO: 109204 - DNA, 1426 bp, Homo sapiens
gagagagagagagagacagacggggagagaaagagagtaagacagaagacagacacagtgagacaggcagagagggagagagagagacaaagacagagacagagacagagagaaagaaagagacagacagacagacggcacaggcagagaaggagagtaagacagaggacagacacagtgagagcagacatgcagagagagagagagagacagagacagagagagacagagaaagacaaagagagagacacgcgaggcaaacagagcaggcggggtgcgcgaccagcgagcaaaggacaccgcaccagatagcacagagagctagcagaagcgctcgaaagagagggaacaacgaggcggagcagacacaagagccgcagaacaccacagactagggaaacgcgacagcacacgcagcggccggcacgcagagcgacagcaggagcagaagaagaagagaagagtcccaggagtcagcgcggacaagagaaaggcacacagcacaagcatgagcggcacgacacgatgagggcagagagacggagggggagagaaaagggggcgggacaagaggcgagcaagagaaaaggaaaggaggagaggcgaaaggaggaagagagcacgggacgaacacgagggaagcgcggaggagccggcagaagaaagacgagagggagagacgacggggaaaagaagcgagaggacgagagcagaggagaggagaagagagagaaggagagagagacgagcgaaggggcaagagagcagaggaagcacgagagaagaggagaacgcgggagagggggacaagcgagcaggagaggagaagagaggagcagcgagaggacaagagggcagcgggggaacggaacggcagcggcaggagagggacgcagggacgagcggcggcgagcgggagagaaaggcgggagcgcggaggacggggagtggggagggaccggagacagggcgcgaggagggcgaggaagcgaagaggagcacaggggggaaaggagaagggcacgcaagacagggacgcacgcgacaacggtgaggagcgggagacggccgtaagaggcggcagaaaaggagacagagagaacgggagaagagacagcggaagcgacgaggaaagagagcagcggagaggcgaaagagaagaagagagggagaagagagcggagaagaagagggacggagggaaggagggagcggagggagggagaagagagcagcaggggagggggagaggagagagaggagaggtgggacgcggcgacgggggaagagagcacggcgggcagaggtagagggagagggcggagcatgcaggggggggatgagaggaagggagacaagaggagagaacgaggaagggaaaggaagggagaaggaggaggaggagggaggcgggaaaggtagagac

SEQ ID NO: 109205 - DNA, 356 bp, Homo sapiens
aactgccatttaagtatcttttagttgtcagacacatacctatctttttaaatatcccatttcatttgattttcataaaattctacaagggagtacttttaaatgtaattttaataaattattcaagttatacatgccaatagcaaaaaattcaaatgaaacaaaaagcaagtttaagaagttaaagttccctttatcctttaccattcacatccagaattccccacaccaggcaataatcaaaattttggtagccacccttctatagatgggtagtgttaacatcatttctatcctacaaatgataaaactaagtatcggccaggcacggtggctcacgcctgtaattccagcac

SEQ ID NO: 109206 - DNA, 407 bp, Homo sapiens
atttcacaacaatttacccaaagaggccttttcgaatgagctgaaataacttcaaagcaaatggtagtgctttagtcatgaattcagaacaaatttagagtttcatgtttaatgagaccgtgcaggaatagaaactgaaaggtaggtcttctaaagggaaaaacagtgggtaaagctttgagtctaatgtggtataaatgttccaaaattctgtcccttctttgcatgttatcttctgaaagtatagcattcctctcagaaattcccgctgatcaaagctagaaaaacttaattcctttatagggtcctatatattatgtctcaattttcaattggcttaatctaaaaaaaaattaagttatccttatgttaactatttaacatgaaaattcggattcttatccatc

SEQ ID NO: 109207 - DNA, 325 bp, Homo sapiens
cacatgctgaaatgccaagtgactaagttagggcagggctaaatgcttttccagcactgtctctcctacttcttataaactgctgttgagatagatgtttttgttcttatattgtggatgacaaaaccaaggctccgagaagagaccacaaaacatatgattagtaacagtaatcacaagctttagggagtactaaatatgccagaaacggtggtaagttatgcaccttacatgaaattttctattgtcttcacaatgatgttttaagtactatcattatccccaattcacaaatgagaaaatggagaaaatttaagtaaactgc

SEQ ID NO: 109208 - DNA, 351 bp, Homo sapiens
cagtaaaataactttttataactatattaatttgggtctctcaacaaacaattattattagtagtttggaaatcaagcctttttgaggttagatagcttgtcccagatcaaacgagtaagaggtaccagaacaagatttcaaattcaggtctaacttactccaaagccagtgctcttaactactgcacaatacagtattgccgcctaaatcccactttaaaacctaccatatgtcattaaattaatgctcatcatcctctattaagatgtaaatgatattgaattaatttaaaacttattcacttattgtaatagattatatactttttgcttttctacatgcaaaatgat

SEQ ID NO: 109209 - DNA, 216 bp, Homo sapiens
tgctttgaagaacactgatttaaaaataaagtggagccaggcgcagtggctcatgcctgtaatcccagcacctggaccctttcaccttcccagactcccaaattttgatatttttctaaactgagttctcttccacccaccattctcctactccaagatcttaggacttgaggatttccctagttcctggttttccaaatggaagtcacagtcacc

SEQ ID NO: 109210 - DNA, 757 bp, Homo sapiens
taataacttaaaacagttcttttcagaaatgcttttctccagctggtttgtcagaaccacattcctgcaaggttgggccagaatgctgtgccccgagcagctccatctactctgccaacagcagccctccagcctctgcgggaagcacgcctccccacgccaacaccctgtagactcctggccccgtggactgtcaggcagttattttggcctgggacgtggctctgctaactggctgctgtgtttttccagttgtgagaagagcttccaggggagttcttcagataatcatcatcttgatcttaaatgtaaatattgtcaccgtggtttaaagagagattaatgatttgccgacagctccatacatccttaggaagtgaacacttgattgtctatcttatttccaataatactagaggaaaaggcacaccctacaggtggctgcaggtgccaccggagcttggagcgagtgaaggccgagcctcggactcgggtatcatttctgaatagctcgccaactgtgaaggaagttctgcggttctctgtcacggaggaaaacagcagtgagtgccatccgccaggctgtgtgccaggtgtcccgtaatcccgtctttaccttctggaggagctgcgaggcggcgtcattagctccgtttcagagaagagaaggcggagggcaaagcaggtttgctgaggcatggccagtcatgggcagtgtccagagccaaacccggggcttgccacatccggctcccct

SEQ ID NO: 109211 - DNA, 476 bp, Homo sapiens
gggttttgccatgttggccagcctggtcttgaactcctgacctcaagtgatcctcctgcctcggcctcccaaagtgctgggattacaggcgtgagccaccacgcctggctgagatggaaacatttctaaagagattgcttgctttaaaccaatttgaatatttaatttaattttgtttttgtagagatggtggtcttgctgtgttgcccagtctggtctcaaactccagcctcaggcaatcctcctgcctaattttttaaaagttattttttcctatgtaatcagcatgtggtggcttgtgaaggaaggttagctgtggacaaaaataagggagcatattcattccctgcccatttgaacgtcaggttaactgagttaagtttgtgtcctatgtcggtaggtactgtgatcccaaactctgcgctttctttttttttttttgagacggagtcctgctttatcacccaggctggagt

SEQ ID NO: 109212 - DNA, 487 bp, Homo sapiens
ccatgttccccaggctggtctgaaattcctgagctcaagagatctgcccgccttggcctccgaaagtgctggggttacaggcgtgagctactgtgcctgtcctatggttttaactggtccttaaagaatgattctgcattgagtacaaagggggtggttatggttacaggctggagaaacagagatgggaatgagtactttccatggaataatgagacaaacattgtgatttaatgtacagagtaagaactacagttaataacactgtaatgccagccagatgtggtggctcacacctgtagttcaagacagctggggtgacagaacaagaccttgtctctacaaaaaaaaaatctggactatggtggcatgcacctgtagtcccagctacttggggaactgaggcaaaaggctcgcttgagcctacaagtttgaggctgcagggagctatcatcatgtcactgcactctagcctaggcgatagagg

SEQ ID NO: 109213 - DNA, 292 bp, Homo sapiens
ccatgttccccaggctggtctgaaattcctgagctcaagagatctgcccgccttggcctccgaaagtgctggggttacaggcgtgagctactgtgcctgtcctatggttttaactggtccttaaagaatgattctgcattgagtacaaagggggtggttatggttacaggctggagaaacagagatgggaatgagtactttccatggaataatgagacaaacattgtgattgaaactgtaggttcaattttattaatagaaaaagcaggtctttggtttttgcaggatcttg

SEQ ID NO: 109214 - DNA, 777 bp, Homo sapiens
cgaaagtggggtatttaagttccccactattacggtattgctatttccccctttagttctattgatagtgctttatatatttaggtgctccaaattggggcatgtatatatatttataaatgttacattctcctgatgaattgacctctgatctcttttaacactttttgactcaaagtctattttattttatgtaaggatcctctgctctctttggttaacatgtgtgtggaatatctttttccatctcttcactttcagcctcagtcctttaaagctaaagagagtctcttgtaggcagcatataggtggatcttgtttttaaaaatccgcttggctgggtgcagtggctcacgcttgtattcctagcactttgggaggctgaggtgggtagatcacctgaggtcaggagtttgagaccagcctgaccaacatggtgaaaccccatctttactaaaaatacaaaaattagctgggtgtggtggtgggcgcctgtaatcccagttactcaggaggctgaggcaggtgaatcgcttgaacccaggaggtggaggttgcggtgagctgagatcacaccatcgcagtccagtctgggcgacagagtgagactccgtcttaaacaatcaaaaatccattcaatctgtgtcttattggagagcttaattcttttcatttaaaataattattgataggtaaggagttactactgccattttgtcagtttttctgactcttgtagtttctttgttccagtcttcctctctagccgtcttcctt

SEQ ID NO: 109215 - DNA, 268 bp, Homo sapiens
gggtcagttggaaatggggtactctgtggttcctacactacagttggtgactgacattggcctaggaattaagagttacagattcttttaaaaagaactagtgaatttaaccaactgtatttcaaattcatatttctaaatacattcctcctagaactttattttctttgtagctcatgtaattgccatcactaaatcattactggccatgcaagtccagctaaaaatttatataatggtaaaagtaatttttgcagacttactcttt

SEQ ID NO: 109216 - DNA, 707 bp, Homo sapiens
tagggaagtattttccagtttttttcatattaaaagctatgatggatacagttgtttttaaaccgtgttcagaaatcacaacatttaactaaggggtttctcccctggtgctcttctgtatgcaaatttgaggttatctaaattgtcagactctgggacacagggttgttttgtatttaagtaacattttgtatatgaaaaaaatctttgacagtaataaaaataagccgagaagtcattttttctgttaaaaaaccttacttgaaaaagagaatgaagaatcactaatttctgttttcacactttagtgatattctacttgcctttgatctgtagtagtgtgtttttgtatagtgctgtgttttctaatgtgctgacatactactggcgatttggtagatatttttagattatattcaggtgaacatttaaattataggaaatttaatgctgattaggaaaatgtataatctaatataccaaattggtggtttcataggtcttaatatttttccctttattgttgtacccacatgcaagtcttaatagtttagggttaataaaatgtttctaaaaaaatgagttgagattctgatacatgctacaacgtggatgaactttgtgaccattatgtacagtgacataaacgtgacacaaaaggacagttattctataatttcacttaaaatgttcctagaatagtccaa

SEQ ID NO: 109217 - DNA, 331 bp, Homo sapiens
ctggtgttttggaaattttcatatgcaaaactccttttgtgttaaaccaattaagtctatgattataacccattgttaaacattaacctactaattctgctcttctagtcctctattttaaaaattatagtcgtctttgcttaaacataaaataatgattttaaagtctgaatgttaaaaattaatttaatgtgtatggtctattgtatttaagccatatcctagtggtcatttacttttactagttcaaacactaacagtttaagacttgtgaagcatggttttgatattctccaggcttgacatatctcagtaggtgataaattaaaaa

SEQ ID NO: 109218 - DNA, 304 bp, Homo sapiens
gttcattagcaatagtggataataatattatgcgtcacgaatatttcatagccataacagtagcccttaagcatgaactttttcttaccttcctactcacaagtctttaacctatctttctgtatctttcttggtctcccagttctccctcctcctgcccacagttaagcttccacaagcctccaccttgactcagtcattctcaagatctagttctttttctgcctcctctatacatgcacgccctgtctttcagcagttccttctcttagcttccaaatgtgctgaagaaactccaacatgc

SEQ ID NO: 109219 - DNA, 387 bp, Homo sapiens
ctgtgctcctgtgtgtgtgttgggttggggttgtgagactctacggagctgtgttgggggatgtgaggctgggggcgacacggtacttgtgattgtccctgggtgtgtctttgtgaatgggtgtgtaaggttttgtgtgtgctgggcgtggtggctcacgcctgtaatcccagcactttgggaggccgaggtgggtggatcacgaggtcaggagatccagaccattctggctaatggtgaaatcccgtctctactaaaaaaacacaaaaaaaattagccgggcatggtggcgggcacctgtagtcccagctactcgggaggctgaggcaggagaatggtgtgaatctgggaggcggagtttgcaatgagccgagattgcgccactgc

SEQ ID NO: 109220 - DNA, 434 bp, Homo sapiens
atttctcttgtgtatatacctaggagtgcaattgctgggtcatagggatgatttgaagaatgtcaaaatattttccaaagtggctacacctttatattgccactagccatggatgaaggttcttgtttttccagatcttcaacacttgttatcatctgactttttaattctagccatcctagtggatgtgaagtaatatttcattgtagatttgatttgcaattccctgatgactaatgaagttgagcatcttatatgcttattggccatttgtatattgtctttggaagaatgttaattcagatcattttctaatttttaaattgtgttgtcttttaattattgagttgtacgtgttctttatgtattctagatacatctgttatcagatatttgatttgcaaatatattctgtcattctgtgtcttttcact

SEQ ID NO: 109221 - DNA, 311 bp, Homo sapiens
aggaaatgaaccaaaacttgggttccttgtatttggatttcaaacaaagaaggtcaccaagtgttggtctgcaaatgagctgtgtctgcagggcaattttatttttaaatgcaagatgacagagtgaaatttctatgtttgatcttagccaaaagtctgagaagtaatgtgaaatttctttattacaaaaaataaaccgggctctttgatctggaagtgctgcctttgttctataaaatgaatgtttgccggggctcggtcaaaggtggcattctgtgtgtcggcttcctaatctggctaagagaaacttt

SEQ ID NO: 109222 - DNA, 231 bp, Homo sapiens
acagagccactctcccgccccagctggccctgccccagcctgcaaggcaactcaatgcacttggcattgagagcagcctcagttccctagaatactctcattcttttggaggtctcctgagacaaaagtaaggcatgatggatacagagctgtgaagagatgaaagagagaatgaaaaagtgccaacagaagaggatgggtggggggtctccagcgcacccgggagcacct

SEQ ID NO: 109223 - DNA, 389 bp, Homo sapiens
aagcttctctgtcccctttcctgaggggaaacccctcgccggtgagccttccagccttgttcattgctagaactgccctagagatggttctagtttcacatcctcctttctttgtgctgataagtcgaactctttcttttctctttttttttttccttgccagcaggaaaaaccactgccagtcccaactgtggttccagtcacaaggatcctcctccaggcctcagagaaaaagaaatggttaacacggctttctgcaccatcccaattcagccaaacctgcagctatgacatcagtggtccactctgaacactagattcttcccactcaaaaactaaggccgggagcagtggctcacacttgtaatcccagcactttgtgaggccaa

SEQ ID NO: 109224 - DNA, 289 bp, Homo sapiens
gtggttacaatggaaagttacaacaggttctgttactgcaatggcatttcactgagaacaaagacttcactaaggagagaaaacttggaagcaagaagttgttctgggccaggcgtggtggctcacacctgtaatcccagcacttcgggaggccaaggcaggcagatgacctgaggtcagcagtttgagaccagcctggccagcatagtaaaaccccgtctctactaaaaatacaaaaattagccggcatggtggcacgtgcctgtaatcccagctactcaggaggctg

SEQ ID NO: 109225 - DNA, 467 bp, Homo sapiens
ttagtagtgactgggatttcgcatgtcggtcaggttggtctcgaactcctgacctcaggtgatgtacccgtcttggctcccaaagtgctgagattacaggcatgacgcactgactgggctgaaaaatttggcttttataatgcgtgtacctctctctctggagtggctaatttattggaagactgttgtagctcaacttccattatcttgaatggtctcagaaaatgcattatttccaggacgggactcagacttttctcgcataactgatttacaacattcaagacgtactttaaaggtggggtaatttgccgagtaacttcctatatatgcaagctcatatttcttctctggggaattgtgcataatgtagttgtaatacagtgcttcttaatgtttcttcccttatcttactggtgagatatgcttttaggggtcctgaaatcccctttaacctcatctctcag

SEQ ID NO: 109226 - DNA, 364 bp, Homo sapiens
atttaaaaaaaaaaaaaaggctgagatgggacaggggaaaaggagacaaccatccagagagcagagtgttcccagcagagggcagggggtgtacaaagacctgtagtgaaggtttggacctgcagacttgagtgttggtggatacatcattacctttatcaggggttgccaactgttttccaaagtggtctatccccattttgtccccagaggggtctttctaaagcacaaatctggtcaagatatccctcctacagcttcacagccccctcagaatcaagtctgaaccctttgctgagcatcctgtggccccacggagtctccagccctagtcccttgcctcttctttctccacaatgtgcat

SEQ ID NO: 109227 - DNA, 282 bp, Homo sapiens
aaacttgaaagattagaggaaaagttttctgtgatgaaataacattgctcagataatatttttatataggtcaagtgcagtgagttttagggatgccaccagggtagtgaattacgtgccatcatccaggctgaactttctttttactctgtccttctacattcttggcaaccattgttcattgcaggtgatgaaattaatatcttggtggagcacttgttagtttggtagtagagtaaaagtaaccccaaatttgagagctaggagctgtagatatgttcc

SEQ ID NO: 109228 - DNA, 692 bp, Homo sapiens
ctaggaggtgagtagaaatttttgccttccatcgttttaatgtagcaaagcaaaaaacagctgaaaagggtagttcacgaaactatcatagcatcttaggctctgatgtcagcctgggtttatgtctccactattccattctacataactagctggctcaatatataaccagtacaaatccttggtttgtccactgtaaatcagctttactttctagttcactgagtggttatcagaatcaatggaaatggtgtgtagaaagtgctcatcactatacctggtagctataagcttttaacaaaagatattttcattagttgtgatgatgataattattaaagctctggatgactaatgaactggctaaggttattgcattttaactctgcaaatgcatggaaaacactccccgtgactgggaatatcttaaatcagtgcgggacttgccatattctgatggctctttataacatgttaaggtggccttacctaatttcagatttcactcaagatctgttatgagaggctgggaggagacttttataaagctgtattcaaaagcaattatattattttcagtgtatttttaaaagattcagaaagaatgaattattttccagaagtaagatttttaaaaattcattgataatatataaggccgggcatggtggctcacgcctgtaatcccagaa

SEQ ID NO: 109229 - DNA, 228 bp, Homo sapiens
aaaaaaaggggatttagcaaatggcaattattactacttattttaagaagactgtgtctaaagataacaatttaacgtgcagctgcagagagtacatttacatatcattctgtgatatgtgacttttcatttagactaaataacttttaaattaaaatttcccattattttattatgaaaaattaaaaatatagcagagttaaaggaattttcccttgaacattctta

SEQ ID NO: 109230 - DNA, 186 bp, Homo sapiens
tgggcacggaggacatgtgttgggtgggtggagacccactgaccagtccgtttgacactgagtggttcatgtcacgtcctgtggacaggctgcaggggagtggtgtggctggcagctggtgtgggccgaggggctagtgtaccctttccacccctgtgcatctcctccgccttggcagtgggcgcg

SEQ ID NO: 109231 - DNA, 268 bp, Homo sapiens
  misc_feature (26)..(26): n is a, c, g, or t
tccttacgtgcgggctgggtgcgggngctggggtctgtatcttgggtcctcttctggatacatctagctctgctatgtttcttatgcatatagcacagtgtatgttatgacttcctactgcattgtggtttggcctagctgttaacatggtttacgcttttaagggtgacagtgttagggtgcacctagcagtttcgcctgcatccacacgagggcacatagaatcctattgctcatgagatacaatctgaccctccccttctttttt

SEQ ID NO: 109232 - DNA, 548 bp, Homo sapiens
agggagttctgaactgtgcattagcctattcgcagcaaacaggcaaacttgcaggaggctaggaggaacactcaaggtttgggttcagggggcagccagcctgcagtctgagcacttctagttgtgcagccgtgggcaagagactcaggagagctaaggactgatactgcctcctcccacaagcctggggtgaggagtaaatttgagataatgcaggtaatgcaacgcccagcacttgttaaacgttcagcaaatgttagctattatgattacaaccaaggagaaactggatggatgatagaggagttaaacagaaacagaaaaactgaggtttctattatagaaattagtcaagtcccctacaaatcttgggatttcctaaactgaatccttgagaagccagcagaggtgtcattcagtgctctggagggcaatagaaggataatcataataatggctcattgtgtacatattatttcccaggtgacattgtccatcatttggtaaaacaatgcacccagtttccatctccagcaagaacaggtacc

SEQ ID NO: 109233 - DNA, 454 bp, Homo sapiens
gcgaaatcccattgttaattggcctccaacttagataatgccctagaatgacatctatccaaaaggttatctagtgaggacaagggctcctgagtatttcaggtcccgagcagaatccagcttggaaagccagtccattacctggcccccgtagactgcaagctcacccagggccaaggctgcaagcaccatactaagtacttgaagcagtcctgaacaaaagtgtttttatctttgatttataaattaggacacagaggcgtggaatggctaactggcttgcttagagtcacaagtctgaagttaatccagggatatctggtgccacaagccaagctctttgcaggatgttcttctgccttcccaaagagtactggtccaggatgaggttcattttcctgacttggaatgctttgcattgtctccctccactgagccctcttcattgtgtctt

SEQ ID NO: 109234 - DNA, 251 bp, Homo sapiens
agatccatcatgtcatgctagcctaacttactactactgtctttcatttttccccctttttggcacactccaactattttctgttaaactagtgctgtcacaagaaaacatataaaaatgctcttttgcaaacacactgtttggttctctcctgaactctccagagctatggatttctctcactgtcttcatcaggggtgaatgttgacagatcactgaaccttactgtcggtggtgacaggcttgatgct

SEQ ID NO: 109235 - DNA, 291 bp, Homo sapiens
ccccaagagtttctgctgtgggattgtggacctgtgtaacaaggctttctgaaacatctagcaatgagtgacttgcttctactagatataaaaaaaccttctttcttggatgagagccaaggcagacccgcctctatcagtcacacatcccactgtgtggttcaaggtgagagagctcagacacccacacagggatttgcgtagtttctccagtggcagcttcagatgggaaatccgtgaagcatgggtgtcctggctgtcagtgtctttcacagagccacactgtgttct

SEQ ID NO: 109236 - DNA, 572 bp, Homo sapiens
atttcaccaagtttgtggctttgccaagcaagtgtgataaagcaagagggcagaggaactgagaatgtatgaaaaaaagtgataaaaactgagctcgaaatttaggtataatctcctctttcctctttactgaatcattttcatcaccataaaatcatgatatttctgtgtcttaggaaaaaaactttctcgctcccaattcagctactgtcccatttctctccttctgaaagcaaagacttgtttatgcacactgtcaacaagtcctcccttccaatcctctcttaaacacattccaatgagactttccccaccccactccaccaacaccattcttatcaacaactaatgatccccatgttactaaatccaattgtcaattctcagtcctcatcttatttgtcctatcagcagcatttgatacagctgaccacatcctcttcttggaaatgctttcttcatttggctatatactttgctttctcccaacctcactgaccacttctaagtttcctttaacggaatgcccagggcttagtcctttcttgtcctcttctaactacagtctcttc

SEQ ID NO: 109237 - DNA, 392 bp, Homo sapiens
tactatagaacatttcagggagttaacaaaaatgttgtatttcttgattttgtgatgtttgtggtacagtcaattttgaacaatttgtaatttgtttttatttctttttgcattctaaataaattttcacatttgtacctaatttggaatgtgtaactttgtatgttttttccttagagagagaccctaaccctcacccaagtggtataagcttcaaaggtggacccacacaactcagacccacctctgtacagagcttgcactgcactacattcctacatttcaaaaatgtcttaaatcacaggtcccagagcaagggaatccagaatacaaaattcattttccactttgcttagcacggcacaatcaaatgtatttaatgacaggacaag

SEQ ID NO: 109238 - DNA, 268 bp, Homo sapiens
ccagacactggcattcaacgtgattttgaagtgtgatagaccatgtatacacttgattgtgcaccaagaggcataaggtaaaatcttgtttccttcccacctgtaagtgttaagtgcatcagtctcctttctctactggtggtgtcctgttgctccactagtagcccctgatataaaacccgtgtcctccatagataattagtcatgaatccctttccagggcgtgttgttctctatgtggtgatttgaagggagaagttttgaaatg

SEQ ID NO: 109239 - DNA, 135 bp, Homo sapiens
ggcagattatgccaagtcagatgggagccctaatatctaagacctgcctgagaagacggagtgaggaccggtgatgaggacctctggggctgagaggtgggaaagctggagggatagaatacagcctctacccca

SEQ ID NO: 109240 - DNA, 831 bp, Homo sapiens
tgatggctagggctcaaggacctcatcagtgagggaagagacagtatagagcatggcagagaaggggaggctgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccgtgtattctgtct

SEQ ID NO: 109241 - DNA, 279 bp, Homo sapiens
tgcacaccgacaatgttctacaacatccttcacaaatgcacatcgcatgtcttagtgacacaagcccgactcacagatttccagctttgtgcagctatgtgtggccgctcctcctcctcctcccaaagcttccttccccctttccaccacacagactaaggcatgaggctgggcagggggaagggggatactgagtgaggaaaacagagagggcggtggaggtggccacacagcatagctggtgtgctctttacagcaaggcttcagagcagcgctggt

SEQ ID NO: 109242 - DNA, 549 bp, Homo sapiens
cccaactttattgttaacagcctatatcaagatagtattcccacgtggcttagctcctgtcatgcccccctccccccaacagcttctttcttttcagtgatcttgttttgttacttctttcattatttggatgttgacaccatttattttgcccacatctctctatgcccaaagaattgttcctttgtttttttattttaaattccatcaacctattcaaatttataaaaacaaacaaacatcttgcaattatctccttagtggtctttgatttcaagatttttattttctctagttcatcacacagaagggtgtccttaatgtgtaaactggatcacctaagtttcttactcaataactttccctatttaaaaaaatcaactctatgctgccattctagacttcttatattctacttgatatacatcatcccacatttcctaaagcatagcctataagaaattgtttatatcataagggtcattaatggcttgtggtcaaggaaatttgtaaaatgatgagttgaaggaaagttaacatctgaatata

SEQ ID NO: 109243 - DNA, 520 bp, Homo sapiens
atctgtgagacaagagttgtcctgagttgcttgggtttggggcttgtccctgagcctgggggaggtggacctgctgggcagggctgcactgagatgaggccagcaggacagagcttcatgcccagaggccaaacttcagggactttgcaaataagactttgcctctgggcaaacacagctccaatcagctttttgctcaatacctaccatgattcctacaactcaataataaaaagacaaataaaccaattaaaaaatggccaaagaaactgagcagacatttagaatagagaaagaatgtataaaaatggccaataaatgtgactagggggcggtatctcacggctgtgatctcggcactttgtgaggccaaggcaggaggatcgcttgaggccaggagtttaagaccagcctggacaacatggcgagaccttgtctctacttaaaaaaaaaaaattagccagggatggtggtgtacacctgtagttcccagctacttgggaggctgaggtgggagaat

SEQ ID NO: 109244 - DNA, 197 bp, Homo sapiens
aagctggaaaaattagaaaatactatacataacttgaggattcaactcaattttaaaaattttctttgtactgacatttgccattctgtttattttttgaatatatgtgcctctccctactcactttatatgaaataatgtagtaggctgatggttggggtgggagagatgaaccactttttcatgttcacacctgc

SEQ ID NO: 109245 - DNA, 312 bp, Homo sapiens
ggcccagcactccctgcccctggtagctgagggcatctcaagggtcagacagggcgctggccatccctacacaacagaaccaggctcccagtccctcaccacactcttgggataaacccagcagagcccatgccagccctccctgggtgagaagcactcattttagagaaaatctcttttctaggctgggcgcggtggctcacatctgtaatcccagcacttcgggaggccgaagcgggcagatcacttgaggtcaagagtttgagaccagcctggccaacatgacaaaaccctgtctctattaaaaataca

SEQ ID NO: 109246 - DNA, 473 bp, Homo sapiens
cactatattggtcaggctggtctcaaactcctggcttcaactgatctgcctgccttggcctcctaaagtgctgggattacaggcgtgacccactttgtccaaccagtacttacttgctttttatttcttgtataattttaccacatatatatgtatcccaaaagaacatagttgagttttgactgtttttgatcctaaataaatggaataatagattattttatgactgtttcttaattactcagtatcatatctgtgagactcaaccaattggatacaagtagttgtactttagtaattttctttgttgtatagtagtgtctgaaatgaatacatcaaaatatacttacacattctattccattttatttggattacttccagtattaggctaaacattgttgctacaaacattcataaacatgtctctgatacctatctgccaaggtttttttaaggcagatgctggtaaa

SEQ ID NO: 109247 - DNA, 521 bp, Homo sapiens
acaaatggaattaaccccccatacacaacatcgcatggtgttgtgaatgtaacgaaaatattttttaaaaaaagaaaagaaagagttgcatgaaagtaatctgttatccaattaattgcagctaaaaagtatggccctgcaataaggcggagactctgggagaaccccatagctcagccatggcaaatgaactaattttaccttttggccacatctgattttgcctcatttgcaagatacagtcataatgagaaatatgaattaaagcaaaatgtctaatttattgtcgtgattcatgtggcagattagtaactagggaaatatagagttcaacggaatgttgtgcttcaaaacctacatttattcataggtaactaatcattttacaaaagtattcttcaagtcacttcagaatttatctataatgcaaaatatttttatatgatgtttcccaatttttttatgtcaaaaattttccgccgggtgtggtggctgacgcctgtaatcccagcactttggga

SEQ ID NO: 109248 - DNA, 407 bp, Homo sapiens
aacagaggtttgataaagtaacagtatataaaacaataatttatattatgtaggaaaattactttggatgactttcttagatataagatgaattgcactgaaatatttgagtagaaaataaaatgctttactaatggagtgatcaattgctgaaaattttattttctataaaacttgatcttcagttataatgtactttagggaccttaaatttaactttagctgattttatcatttcaccttgaaattttagatgccaatttgcagggcccaccattcccataataataatctctgttgcctgcccaaagtgggtaccatatggtgggggaatggaggctagtggaataaagtaaaatcagctgtggactgaatggttgctcgtttatctttgagtctttattcac

SEQ ID NO: 109249 - DNA, 364 bp, Homo sapiens
aagaatgatgtttatactaaactccagtttgctgttatcaaaaatatggcctatcccataagtcaggaaaatacattatttaaaaaaaaactatttatatcaaatgcaatttgctgtatgggaaaagtcttttttccaatctttatcatttctgaatgtatagtgctgactgtggaaacagagaatggtgtgacaccccaggatagagccccaggaaggaagatcttaatcaacgttacactctctgtgaaagatttaaaacccagaaatacaatacatttttttcttccttccttgctctctattttttttttccatttctaggcattctgtatttttcagcaagggtggttgtgtttcgaag

SEQ ID NO: 109250 - DNA, 376 bp, Homo sapiens
ccccagagtccaaacagcgcccagagcaagcgaattgtgggccagattatcccagccattgccaccactacagcagctgtggcaggcctgttgggcctggagctgtataaggtggtgagtgggccacggcctcgcagtgccttgcccaaacccctacagctaagaagtgacagaaatgggacacaaatccaggcctatgtgacttgaggcctttttggacaaaactcccccacctcacgaagcttccttctcctcatctggaaaacgaggatagtaacagtacctattccatagggttgttgtgataagtgacatagtacacacatagagttaggtttcagtagctagcacacaagaatggatcaataaatgttag

SEQ ID NO: 109251 - DNA, 377 bp, Homo sapiens
gcactaaggtgggtgttaggtgaggaaatacactaaagcaaattatcattctaaaatgctcagtcctaaatggacaagtcactttgtaatactgggccaggttcggcagtaagtagaggctttggtagcaaaaacgaactgggttcaatcttggctctgccacccattcctggacaaaatacttaactctctccatcttccaaatgtgacctacaccttacaggactgccaggagaattaaggaagcacatacacagtgcctgacacacaagtgagtaaacaccttaaactatgtttagccacagaaccagagtggttggagggagagatttaggaacttccctgggagtaaacagatttcataactgattctattt

SEQ ID NO: 109252 - DNA, 634 bp, Homo sapiens
caccagcccgggtcgcacacagctcacacccagaacacacagctcacacccgggacacacagcttacacgcgggaaacacagctcacacccgggacacacagctcacacccggaacacagagctcacacccgggacacacagctcatacgcaggacacactcagctcacacctgatacaaggacagctcacagtggaacacacagctcacacccgggatacagctcacacccaggacacactcagctcacactggaacacacagctcacacccagaacacagaactcacatctgggacacacacagctcacacccgagacacacaccctcacacccagctgacactaaaaccaagccctgggcaccagagctgaccacagaggcaggcagggctctcgtgagagcacagctcacaccagggacatgctcagttcacacctgggacaggcacaacgcataactgagacacagctcacacctgggacacagagcccaccccagcgcctgctcagctgagcatctcccagccgacctcggggcctgggctcaggtcttgctgaggacccagcacacacggtggtcacagtcaggggtccacacgccctgtcctccgtcctccccacagcccagcagg

SEQ ID NO: 109253 - DNA, 518 bp, Homo sapiens
acttccggaggctgaggcggacagctcacctgaggtcaggagtttgagaccagcctggccaacatgatgaaaccccatctctactaaaaatacaaaaattagccgggcgtgggggtataagcctgtagtcccagctaccagggaagctgaggatgcaccgagcatccactgtactccagcctggacgatggattctctctcaaaaaataaacaaaacaaaacaaacaagcaaaaaaaaatacctagtgtttggaagacaaagcttgggacttctataagttacttctataagtaacttgactgggtgtatttctcaccaagacccctggaagctagacccattgtttgttataagaaataattgacccttacagggcatgtggtctcaaagtagttaatacactcacttgtgtggcctttttccaggctatcaccttggagctctgctgctgaggactcctgctgaacacacatgcctgatgctgccttactagcatactttttctcatcttgcaatt

SEQ ID NO: 109254 - DNA, 217 bp, Homo sapiens
ggtcgaccttccaggggtcttggtgagaaatacacccagtcaagttacttatagaaataattgacccttacagggcatgtggtctcaaagtagttaatacactcacttgtgtggcctttttccaggctatcaccttggagctctgctgctgaggactcctgctgaacacacatgcctgatgctgccttactagcatactttttctcatcttgcaatt

SEQ ID NO: 109255 - DNA, 520 bp, Homo sapiens
gtcgcagtctaattcctctataatggaaatgcttataggcggcgacagcctatgcctccattcccattttatagactgtgcacagcgactacctatcgacaggaccaatttaagagtttcatgtatacagtgtgatggtgcttgtaaatgacatacagcacagtacaaaaattttaagcctaactactgctaatagtcactctgtgacttttcctgtgatgtttatataaggaatcttattaccttcaaacactatttcatagatttagaaaaaccaacataggatacttcaggactaccacgtatgggctcacttaactaccattacacatttctttcaaccttttaatcttcttgttaacaagctccctgatatatattagtacattttatgtctgagtatacagggcaaaatggtgctagatatgtttcacggtgactgtcactcgtaactcctcctaagggaaagtacccagccttctggaccaggggaagttttttgttaacagtgagatctctt

SEQ ID NO: 109256 - DNA, 273 bp, Homo sapiens
tgacagcacccctatggagaaggtccatgcagacatttgtacaggacacacacaggaactaactcagctgtagataaaacaagtgaattttgttctgaactgaagatggtgaccacttgagatccagatgctcagtatcttcttatatctccattaaaaagtaattaatatattttttattaattcgattttaattagatttgtgaaaaattgattcaaataaattcctcttgtccatggtacagaccagctttagcagacagcaactgtatg

SEQ ID NO: 109257 - DNA, 429 bp, Homo sapiens
ttttttcctgctccttcacttcttaaaccttttaataagttgcatgtggtttttcttgccctaaagtttaagtcttaaattgaccagcaatttaggagccttacattgtttctcaaagaagttgagactggttatgatttttaagaagatttactgaaaaacttttagtgtcagatattggttcattgtcagatccaggagcatttggcctggcattatgactttatcttttttggtacattttattcccttttccatctttaaaactagcagttaggtcttccagcttcttaacttatgttttggcctgtaaaacttctttctaggatattctttatggtgctgccagtttatctttcaaatatcgatttcattatgtctacttccctattaaaaaacttttgatggatttcctgttgcctggagagt

SEQ ID NO: 109258 - DNA, 702 bp, Homo sapiens
taagtgatcttcagcagtaggacattagatatatagatatatccagttttcaattatgaactgttatgctaagtatttttatgtagctttttatacacaattcctatttttgtatggtgaagggaatgggattttaattcttatattgaatgtaccttgcaactatacttctgttttatcttagatattatcaaatgatatatttaaatatttatcttggtaaataaatacttgataagttaggtcacttttgtcacaaacaaaatttttaattttttattctatttctacataggtcagttgtagttgtaatgaaggaatcataattcctcaaatctaaaaattagaaagatggaaactgatatttcttcacatttaatagtttgattatacatcttatgattaatgttagtattatctgagacaaatatttcactgtcctttatgtaaagttctttatgtacattgtccactatgacaaaatatgtctcttaatttaggtcttggggaatgaacacttgtttttaatattagcctatcagagtaagcactttaattggattagctcatttaattctcataacattgcatgaactataggtagcattttatcctattttatacatgaggaattctgactcatagagtcctcatgtgtcatagagtcctttgtagagctgcaaagtataggcagtaatatag

SEQ ID NO: 109259 - DNA, 369 bp, Homo sapiens
agactctatctcaaaaaaaaaaaggaagagtcccgggtgcggtggctcacacctgtaatcccagcactttgggaggcagaagtgggtggatcacctaaggtcgggagttcgagaccaggctgatcaacatggtgaaacccatctctgccaaaaatacaaaattagggcgtggtggtgcatgcctgtaatgctagctacttgggaggctgaggcactaaaatcacttgaacccaggaggtggaggttgcaatgagccaaggttgtgccattgcacttcatcctgagcaacaagagcgaaactccatctcaagtaaattaattaaattcttcctcttttctgagcatcgctataggctttaattataggtt

SEQ ID NO: 109260 - DNA, 801 bp, Homo sapiens
gtcatggacagttcagacagcacgaggcagttcagaaaggaccagggagctgctttgcagttccataggatggtgaaaatgtcccttgaagatacctcagaccaggcaggcttctgacttggaggagttctaagaaaaccatacaatcttttttggtttgctatcaggtcgcagaaatgtgttagagaacagccttccttccctgtgatccaccctgcattgtttgattttagggttgagtgacatgacatatgtgaggatgtagtgagacatacagtcatgactcattatgtttggataatgtaatttcattccggactcaccctcaaagaagtttcattataaatagctgttcattagcaattttaaatatttacatttatgcatgtcatcaacaaaaggctctgaaacacaagaaaatgaatttacgattgatacgtgattccttcaagtcctactttatctttgttacggtgttggtgaataagtaataactgggcaagtacataaataatgtagggaagatagcatgatttagtttttgcactgagggggcttctgtttggatggagcatgaaccttgtggaatactgtgcatgagtagtcctggggctgcaacgaggtaaagagaaatcttttagggattcagccgcctgaaagatcagttccagaagccaggcacagtggcttatgcctgtaatctcagcactttgggaggcctgaggcgagcgaatttcttgagcccaggagtttgagaccagcctgggcagcacagcacaacccgatctctgcaaaaaaaaa

SEQ ID NO: 109261 - DNA, 328 bp, Homo sapiens
aatctgtggcctctggtgctgtgatttaaagactaaagatggcaaagagtggcttttatgagctgccccactcctgattataaacacactctctatgagtcagaggcctgggtgatcatggataagtcacttgccaacagttaactccagactgtagctgctggggccaccgagggcggctggaacatcaccattctgtgcctagcgtttcagccgggctgaggccattttattaataatgatttattgtttttattgcttcccagagatattaaacatgaatcaaataatgcatgtgatgattcactggaggttcccttccaaattt

SEQ ID NO: 109262 - DNA, 112 bp, Homo sapiens
tgaactagcatctagggcacagaaagatagagggtgatcacttaaaggatcattggctgaatgtggcggctcatgtctgtaatcccaacactatgggaggctgagttgggaa

SEQ ID NO: 109263 - DNA, 285 bp, Homo sapiens
gagagaggaccattttggtcccacacctgacacacagcacacctgtgacatccaagagcttcttggaactgacttgccaggagggttcggacttcgcgtgagcgggggtggggccttctcagggagcgtcccttgactccagaacgcccttgctggcggctggcggctgggtggggataggtgttgttagctcctctttcctgctgcaattcctttccacagagccctggactcaaactacacatcaccccagatcatcgaggcctggaaatctgctcccagagg

SEQ ID NO: 109264 - DNA, 557 bp, Homo sapiens
cagaactttagtttatccagtgggggtgtgtgttcaggagaggaggatctccctttcccacttcagcagttggggcactcacagtatttggggtatctcctgggtcctgcaagagcagtctacttccctcagagggtttgtggctcctctcaggattgctagcttgttcttgcagttgatcttagctaaaattcataatgcgagcctctgcacgctgctcagccctgagctgcaatcaatctagtcctgcctctcatctgccatgatgatcctccttccaaataaatattaaaaaataaaaacaaactgtaatctgaccgccttgggcacagtttctcaagactccttgagactatttttccaagtcacagtcactcatgttggttcagaataaacctcttccaaaatattttacaaagtttagtttttccattaacaagtagaaactgtccttttatacgcttagattcaacaaagtatggatggctatgtagaaataggattgggcaaaagggtataatccaatgttaatagacgaagtggggaaacccagcaag

SEQ ID NO: 109265 - DNA, 423 bp, Homo sapiens
gtacacgtgagacatgctagtatactacctttgacgtaggtaaacgtgtatgttttttttggagagagagggacttgctatgtcacccaggctggtctcaaactcctgggctcaagcaatcctcctccctcagcctcctgaatagctgggactacaggcctgtgccatcatacccggctaatttttgtgttttttttggagagagagggacttgctatgtcacccaggctggtctcaaactcctgggctcaagcaatcaacccacctcggcctccaaagtactgggattacaggtgtgagccactgtaccggcctcctttaaggagttgtaatcacaaagtgcttatctttgtatttcataatgctgggacagacagaaaagagacaaattagagagagtgggactgcaggaggtggtagagg

SEQ ID NO: 109266 - DNA, 396 bp, Homo sapiens
actggactactctaaaaacaaaatacaggttattaaaataataatatagaaataaaataaaataaaaaagtaaagaaaaagcaagttactgctccactcccaacctcctgagccttggaaatatgaatttttgccaagagcccaggtggttcctaagcacaccaagtttgttctctgtccatccttcctccaacctgctgccacaattctctcaacgggaggatttcatcccaactgccactacaattacctgacaagctttgagaaacagtgaccactggccccaccccaccagtgatgagcatcagtgtgggagggggcagggagccacagtgttaaaaactcccaggtgactggaagaagcatacagtctcagagccagggcccactcccaaa

SEQ ID NO: 109267 - DNA, 778 bp, Homo sapiens
cattttcttgtaataaatgcgttcccacctctcaaaactcgattgtgcctagctattagcaggccagctctgtagtcagttccaggctggaaaatttcgctttttgtcattctctggcatggtgaattgttcaggaatatctgttagctggtgttctttctctagaaatgggcagatctttctgataatattcttatcccttctataaatcttttgtagacatagggttatgaaaccctgtaattcacatgtacctccctttaaagcatagacttttttcaaagttgtggtaaggtaacttttgggaacccatatgtgataaaataaaaaatatgtgtttggtccccagtttcttgtacacaggtcctaaagcccttggaatctccggagtgataggagtgtcttttgtttaccaatgggatgactggtggctggaggcccccagacagcttcagaatgggggctggtcaccagaaagacgaaggcacgattagaggattgggaatttcggccccaccactggggaagagagaggggctgaagattgagctaatcaccagcgggcaatgatttaatcagtcatacctaggttatgaatcctctggagaacttccagtttggtgaacatgttgaggtgctgggaaggtggcgtatccggagagggcacggaagctccacacacctgtctcctcctttcttgccccatgtgccttttccgtctggctttcctgagttgtatcctttataataaaccaataaatataagtcaagtgttgcc

SEQ ID NO: 109268 - DNA, 327 bp, Homo sapiens
gcatctatatttagaaatgagattgggctttaattttttccttcatataccatccttatctgatttgccatcagaattgttatactttgtaaaatgaggtgggcagtgttccctcattttatattcactggaacagtttgttttagataatgattatctgttcttcgaagtctgggtatgactggtaaaccttctgggtttaatgggttttatttttatcttaatttaattttattttttttagtatggagggtagattttaaaactcccaattcaagttataaatctaacccaaaaaatgtatttcttcttgagtagttctgttag

SEQ ID NO: 109269 - DNA, 664 bp, Homo sapiens
gggccatcctaatacttccatccttgtgtgatgggactgttggcccccagtgcaggaattaccctctgcccccattacattttatctttttaaaattagcctattccaatctgagattgttttggatcctgatttgtgtcagccaaggaatttattcccttgccgtttcttgtcaactattgtctgattaagatatgatgtgtcactcatgtaagtagactagtagataaaatatatttgcaacaaggaaagaaaactctgaaagcttcttaaattataaattgtttttaaatgtaaagttttattttctttgatcgatggtactttttcaatttttttctcgaatgtgttccatttttttcttgaatgtcttcataactttgtcttcattgaatcataagcctgagaaggactttgaacttttctgacccaaatttacaccattccaggctgttgaagctctcagggaacaccatctatgataagaggacccttggggcacttagaaaagttggtggagtcttccactttttaaaatctaaacgaggagccaggtggccagaattccaccttgcagttcttgcagttctgccagaaataagattggaggtattgagaattcatttcatctcttcagccaaatgaaactctcaaagactcttcc

SEQ ID NO: 109270 - DNA, 343 bp, Homo sapiens
cctccccacactccaactccactcccttctagttgttttcctgaggtaacggaaaaccttttaaagcaaaaaaggaactatgtccatgtttccaggccagcaagatagggaaagtgagaaagactaataaaagagtagtaggctgggcatggtggctcacacctgtaatcccagcactttgggaggcggaggcgggctggtcacctgaggtcaggagtttaagactagcctggccaacatggcgaaaccctatctctactaaaaatacaaaaattagccagatgtgggggcacgtgcctgtagtcctacccactggagaagctgaggcacgagaattgtttga

SEQ ID NO: 109271 - DNA, 1272 bp, Homo sapiens
cagagaattcacactggagaaaaactttacaaatgtaaagcgtgtagcaaatgttttactcattcttcaaatcttcttgtgcatcagagaattcatactggagagaaaccttacaaatgtaaagaatgtggtaaatcatttaaagtgtcttcagcccttactcagcatgagagaattcatactggagagaaaccctataaatgtaaggaatgcagcaaagcctttaactgtagttcatcccttactaaacatcagagaattcatactggagtaaaactttacaaatgtaaagcatgtagcaaatctttctctcattcctcatgtctttctgtgcatcagataactcatactggaatgaaaccatatatatgtaaggattgtggcatctcctttaaccggtcttcaaaccttagacgacatcagatgattcatactggagagaaaccctacaaatgtaaagaatgtggcaaattatttaatcgatgctcaacccttactcgacataaaagtattcatactagagaatttctatagttgtagtaaatgtgaaaagagttttatccaaaatttagaacttaaaaatcaccatagagtttatagggaaaccgactttacagattgaataaatgggaggaagtatttaatcagaactcaaatctgaatgtgtcaggacttacacaaaaaaggactaaagcacagatccccactttaaaattaaataagagtatttgttatggaggattactctaaagccaaagcagttacttattttgttatgtgtttcaaatgagcaaaagcattgatgtttggacaagtaattattcagtgagcatgttatttgtattgaaaacatttgaaatttgtataaagcaaatcataatttaattctcagattagttgttataccttaatgcctagtgtttatataaaaacatatagtctattttttctgcatcagagctgtaagaggtcgttctatagtaggtgaacatcattaatatcaacttattttcatggaaatttaatggcaaatgtaaaatacatgaagaaaatctaaaagaggctctttgtgtttgaatcattaaacagtaatatgtgtaaacatatagtacatatttagggcattagtattctatactaaagtaaaagaggaatattctgaatttatttattacatcaattgctccttaagtagaaaaacactggtcagttatttaaaatactggcatacctttatagtacaatgaagtagtaatcttgaatattatttga

SEQ ID NO: 109272 - DNA, 460 bp, Homo sapiens
ctcaaaagaatatttaatatattttaattatgcttccccaaaatcttttttacttttgtttggtaaaatattaatatgttaatattttatattactgttatgaaaataaagccaattctgtttgagttgacaattatgaattgtgtcatataaacttttctctaactctcttactgcttatccctactcatacttgtctttggaaataagcttaaaaattacacagggtacatcttagatagcaacgcccaataggaggcatgtacatgtgtgtttagctgcctggctagctgggtagcaaactatgtagattggggaaatggagaaaggaagggtgtttaatgtttaggcagaatatttctgttctgagaacatacagataattttgttgaggataaaactgtgtatatgtgtgtgtatatatgtatgttttctaataataaaaagataaatattgttt

SEQ ID NO: 109273 - DNA, 781 bp, Homo sapiens
gggcacttaccatgaatggagcttgcaggactggaagttgctctgggcaagtcagtgagtgagtggtgaccgaatgtgaaggcctagaaaattcctctacactactgtagactttataaaccctgtacacttaggctacaccacatttgtttaaaaattgattgcactatgacatgacgtcactagatgacagtaatgtttcagcttcattattatcttatgggaccactgtcatctatgtggcccgtcattgaccaagatgttgttctgtggcgcatgaccataatcggaggggagagcaccattagggacgatatcttacatttgttttgctcaggtggccccctgtgggcctttcatgtgatggtcaccaggcctcaatattcaaaaccactcgtcttgagagcaactgaggtcatatgatggaggtagtaatacttttgacgtatgtccacttttccgctcactgttgcttcacaagttagagtaaagccttgttgttaagtcactgagaagcgcttggactttgctttccttttgatgtatttaatcattttaaacataagaatcctcatctcttccccactgcactgctgcccccatgaccccagcatgctagaactgcttcattgctcctaaatttgtagcccatttaaattcaagcatctgttctggcactgtaacacaaggccatgccatgtctatccgcaccaccccaccctacacacacacccttgtgccgtgcctgtcatatcatcaagtgtcttgagattaaagttgg

SEQ ID NO: 109274 - DNA, 916 bp, Homo sapiens
gggcacttaccatgaatggagcttgcaggactggaagttgctctgggcaagtcagtgagtgagtggtgaccgaatgtgaaggcctagaaaattcctctacactactgtagactttataaaccctgtacacttaggctacaccacatttgtttaaaaattgattgcactatgacatgacgtcactagatgacagtaatgtttcagcttcattattatcttatgggaccactgtcatctatgtggcccgtcattgaccaagatgttgttctgtggcgcatgaccataatcggaggggagagcaccattagggacgatatcttacatttgttttgctcaggtggccccctgtgggcctttcatgtgatggtcaccaggcctcaatattcaaaaccactcgtcttgagagcaactgaggtcatatgatggaggtagtaatacttttgacgtatgtccacttttccgctcactgttgcttcacaagttagagtaaagccttgttgttaagtcactgagaagcgcttggactttgctttccttttgatgtatttaatcattttaaacataagaatgagaagagatatctgtgtgaggcccaaaatgagggaaatcggggaaggcttcatgataccagatcatgccatgagaaggctagatgttagcacatctctgagggcgttaatgtgtgaaatacccaccagggcagtcctcagtgagttgtcctcagctgaaatggagcccacaggaaacaggattctaaattctccgggtaaccaccctaccctctagacctgtgctgtccaatattgtagccgctcatcacatacagctactgggcacttgaaatatggctcatgcaaattgagatgtgctgtaagtgtaagatacacaccagattccaaagacttagtacaaaaaa

SEQ ID NO: 109275 - DNA, 462 bp, Homo sapiens
ttgtatccagaaactcaacaaataaaagacaaataacccaattaaaaaatggcaatggatctaaatacgcgtttcttccagggagatatacaaagagccaataagtatgggaaaaaatattcagtatcattaacccacaggaaaatgtgactataaccatagtgagatactgcctcacacccgctaagatgactggaattaaaaatgacaactgtaacaaggagagtatatgaagaaatcagaacacatgtacaccgttggtggaaatgaaaaacagtgtagccagtgtggcagttcctcaaatgattaaacatagagttactatatgtttttgaggatgcaccaaatacaaatgaaaaacatatgtccaaacaaaaatgtgtgttcatggatgtttctagcagtattatttataataaccaaaatgtaaaaacaaccccaaaactcatcaattgataaatg

SEQ ID NO: 109276 - DNA, 601 bp, Homo sapiens
aaattcacatttattcattctttccaaaaaggggattcctgagacaagtcataggcatacccagaacaaaagtagcaatatgacatttttaaacattaggacctcaaatagatgctgtaaagttttatacctatgcctcaagtatagtacccacaaattctgcctgaaaatatttgtagacatatagaagggaaaaatcaagttggtgcaaagttgaaaattaaattttaccatgcccaggtgctttcctaatccttactagaattttctatggcttaccccatccgggaggtgaggggcgcctctgcccggccgcccctactgggaagtgaggagcccctctgtccggccaccaccccgtctgggaggtgtacccaacagctcattgagaacgggccatgatgacaatggcagttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtg

SEQ ID NO: 109277 - DNA, 380 bp, Homo sapiens
tactttcatggaggatatttttccatatgaaaatcaccatgatcaaaagctcacaaaggactattatccagatactaattaaataagaatataaataggagacttgcctctgtaaatattgtcaaacaagactgagtaacgtaatctggatacttgcattaacatttgattttattctgttttccatatctaagtggaactgttttattatatatgaaacagtgtttttatcaaaattcttttgtcccatccagtaataaatgtcttgtataagattcaataaggaatcctcctttatcaagcctcagaagacattcctgctttcaaacttccagatacttaaaatgacaacaacaacaataaaaacaaaataaaacttc

SEQ ID NO: 109278 - DNA, 691 bp, Homo sapiens
tggatgccagtgagcggctgacagctgaagctccctggacactcaaggctcttgtggtgacaggtgaggggactgggtggaaggacagtgctctgagcatgcaccttccttgggatctggaggctgggctgttttttatgcttggcacttatgccacctcagcaacctaaaaacttacaataaagctggagggagcctttcctgaaacttgtgcttggtcacaggatttctgcgatgtatggtccctggagaagcaccaaagggttgggcatgtggcctgcctgaggtaggtactctctcaatgcaccaagaagctgagagagccagaaaaaggaaacagagggaagagtggtgggtagttcatctatcagggctttatagaaggtattttattcaatcttcgaaacaactctagaaggcaggttttcttctcccctgttctatagatgaagaagtggaggctcagagaggttaagtgacatgcccaaggtcacacagctagaaaggcatggagccagattccaatgcaggtctttctcatgctaccttctcccagtggcagaggcctgcttcctcatgggcaaacgcggaaagacacacccttaagcaggtctccctgttcctgcaaggctgggagccatgcaggcactcacgtggtttcctctctcttccccaggcctggcgtaaaggc

SEQ ID NO: 109279 - DNA, 433 bp, Homo sapiens
gctaaaccaattaaatagacaaaaatgactcaaatatcctccaaaagaggtagtaagacatcaaatataaaggctgaacactcactaatgctaacaatgaagaataaacagccaacattttgtctatttatactttaatttttaattatagctgtgtatttgtttaagaaagaatgtctgcctgcttgtatttcccaagaaatgctcacattttataagtctcataatacatatcaagatgttcaatttatccaatacttttatgtaatatcaaggcaaaaattctgaactaaacttaaaattctatttaatcctggccaggcatggtggcttatgcctataatcccagcactttgagaggctgaggcacgaggaatgcttgagcttaggaattccagaccagcctgggcaaatagtgagacattgtctctta

SEQ ID NO: 109280 - DNA, 1061 bp, Homo sapiens
cggtacctgggccgccagggagccgggggtgggctctccggggacagccggcagcgcccccagatctgcaccgccagccgccgggagctccgggctccgggcgtagaggctgcgctgtcacatgggcggcggcgacggggccgcatttaagcggccgggggacggcgcccgcctccagcgcgtcctcgggcttggctcccgccgggagccccgttctctgcccgccgggggccccgcgccgcgccgcaccgcgccgcccccgccgggccatgcgagcgcgggccccgccgcgatgagctcgcacatcgccaaaagcgagtccaagacgtcgctgctgaaggcggcggcggcggcggcgagcgggggcagccgggctccccgccacggccctgcccgggacccgggggctgcctagccgccggctacccggctcctgcccggcgacgccgcagtcgtccggggaccccagttcgcggaggcccctgtgccggccggcgccgcgagaggagggcgcgcgggggagccagcgtgtgctcccccaggcgcactgcaggccccgggaggcgctgccggccgcggcgtcccgaccttcgccgtcgtcgccgctgccgccggcccgcgggcgggatggggaggaacggggactgtccccggcgctcggcctccggggctctctgcgagcccggggccgcggggactccgttccagccgccgcgtccgaggcggacccgttcctccaccggctgcgccccatgctcagctccgcctttggccaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagag

SEQ ID NO: 109281 - DNA, 3163 bp, Homo sapiens
  misc_feature (2471)..(2471): n is a, c, g, or t
  misc_feature (2899)..(2900): n is a, c, g, or t
  misc_feature (2906)..(2906): n is a, c, g, or t
  misc_feature (2950)..(2950): n is a, c, g, or t
  misc_feature (2990)..(2991): n is a, c, g, or t
  misc_feature (2996)..(2996): n is a, c, g, or t
  misc_feature (3001)..(3002): n is a, c, g, or t
  misc_feature (3162)..(3162): n is a, c, g, or t
cgaggctcctcctctgtggatggtcactgcccctccaccaggcttcctgctggaggagtttccttcccagccaggccggcccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggacggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcctgagcaatgcgttctttctaaaagtaacagccctgactaagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcaagccctggacctctctgtgcagtatcctccagagaacctgagagtgatggtttcccaagcaaacaggacagtcctggaaaacctcgggaacggcacatccctcccggtcctggagggccaaagcctgcgcctggtctgtgtcacccacagcagccccccagccaggctgagctggacccggtggggacagaccgtgggcccctcccagccctcagaccccggggtcctggagctgccacccattcaaatggagcacgaaggagagttcacctgccacgctcagcaccctctgggctcccagcacgtctctctcagcctctccgtgcactaccctccacagctgctgggcccctcctgctcctgggaggctgagggtctgcactgcagctgctcctcccaggccagcccggccccctctctgcgctggtggcttggggaggagctgctggaggggaacagcagtcagggctccttcgaggtcacccccagctcagccgggccctgggccaacagctccctgagcctccatggagggctcagctccggcctcaggctccgctgtaaggcctggaacgtccacggggcccagagtggctctgtcttccagctgctaccagggaagctggagcatgggggaggacttggcctgggggctgccctgggagctggcgtcgctgccctgctcgctttctgttcctgccttgtcgtcttcagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccggagtccagtggtgcaatctcagctcactgtagcctcaacctgccaggttgaagtgagcctcccatttcagcctcccaagtagctgggactacaattgtgagccaccatgccaggctcattgttntatttttagtagagacagggttttgccatgtttccctggctggtctcagactcctgggctcaagcaatctgcccgcctctgcctcccaaagtgctgggattacagacgtgagccaccacagctggctgaagattatactttcaattcagagcgagtttgaagatgacactttgaggcatcgtgtctatggttcattactacagaagcttctctggatgtgtaaagcacaggaaaccaggcagaggaggcacagggtgctctccagaacgagaagccagctcctggagttgtttgctgcaactgccattccccgttgatgaccatgctcttccttcagaagagggagagtgagaggaccaagtccaagtggttcccatttgaacatttaaaaaaaaaaaaaaggctgggcatggtggctcacgcctgtnntctcancactttgggaggctgaagtgggtggatcacaagtcaggagttcnagaccagcctgggcaagatggtgaaaccccatctctactnnaaatncaaannttagccgggcatggtggcgggcgcctaaaatcccagctactcgggagactaggcagagaattggttgaacccgggaggtggaggttgcagtgagccgagatcgtcccactgcactccagcctgggcaacagagtgagactctgtttctaaataaataaang

SEQ ID NO: 109282 - DNA, 3066 bp, Homo sapiens
  misc_feature (2374)..(2374): n is a, c, g, or t
  misc_feature (2802)..(2803): n is a, c, g, or t
  misc_feature (2809)..(2809): n is a, c, g, or t
  misc_feature (2853)..(2853): n is a, c, g, or t
  misc_feature (2893)..(2894): n is a, c, g, or t
  misc_feature (2899)..(2899): n is a, c, g, or t
  misc_feature (2904)..(2905): n is a, c, g, or t
  misc_feature (3065)..(3065): n is a, c, g, or t
cgaggctcctcctctgtggatggtcactgcccctccaccaggcttcctgctggaggagtttccttcccagccaggccggcccagaagccagatggtcccgggacaggcccagccccagagcccagagatgctgctgctgcccctgctgctgcccgtgctgggggcggggtccctgaacaaggatcccagttacagtcttcaagtgcagaggcaggtgccggtgccggagggcctgtgtgtcatcgtgtcttgcaacctctcctacccccgggatggctgggacgagtctactgctgcttatggctactggttcaaaggacggaccagcccaaagacgggtgctcctgtggccactaacaaccagagtcgagaggtggaaatgagcacccgggaccgattccagctcactggggatcccggcaaagggagctgctccttggtgatcagagacgcgcagagggaggatgaggcatggtacttctttcgggtggagagaggaagccgtgtgagacatagtttcctgagcaatgcgttctttctaaaagtaacagccctgactaagaagcctgatgtctacatccccgagaccctggagcccgggcagccggtgacggtcatctgtgtgtttaactgggctttcaagaaatgtccagccccttctttctcctggacgggggctgccctctcccctagaagaaccagaccaagcacctcccacttctcagtgctcagcttcacgcccagcccccaggaccacgacaccgacctcacctgccatgtggacttctccagaaagggtgtgagcgcacagaggaccgtccgactccgtgtggcctatgcccccaaagaccttattatcagcatttcacatgacaacacgtcagccctggaactccagggaaacgtcatatatctggaagttcagaaaggccagttcctgcggctcctctgtgctgctgacagccagccccctgccacgctgagctgggtcctgcaggacagagtcctctcctcgtcccacccctggggccccagaaccctggggctggagctgcgtggggtaagggccggggattcagggcgctacacctgccgagcggagaacaggcttggctcccagcagcaagccctggacctctctgtgcagtatcctccagagaacctgagagtgatggtttcccaagcaaacaggacagtcctggaaaacctcgggaacggcacatccctcccggtcctggagggccaaagcctgcgcctggtctgtgtcacccacagcagccccccagccaggctgagctggacccggtggggacagaccgtgggcccctcccagccctcagaccccggggtcctggagctgccacccattcaaatggagcacgaaggagagttcacctgccacgctcagcaccctctgggctcccagcacgtctctctcagcctctccgtgcactaccctccacagctgctgggcccctcctgctcctgggaggctgagggtctgcactgcagctgctcctcccaggccagcccggccccctctctgcgctggtggcttggggaggagctgctggaggggaacagcagtcagggctccttcgaggtcacccccagctcagccgggccctgggccaacagctccctgagcctccatggagggctcagctccggcctcaggctccgctgtaaggcctggaacgtccacggggcccagagtggctctgtcttccagctgctaccagggtgaagatctgcaggaaggaagctcgcaagagggcagcagctgagcaggacgtgccctccaccctgggacccatctcccagggtcaccagcatgaatgctcggcaggcagctcccaagaccacccgcccccaggtgcagccacctacaccccggggaagggggaagagcaggagctccactatgcctccctcagcttccagggcctgaggctctgggagcctgcggaccaggaggcccccagcaccaccgagtactcggagatcaagatccacacaggacagcccctgaggggcccaggctttgggcttcaattggagagggagatgtcagggatggttccaaagtgaagaggtctccatggcaacaggacaccagcaagtgtgtgggagtcgcactggtgtgacggccagaactggactcagatttcagccccatccccaatgaagagcttgagtttgaagattatactttttttgagacagggtctgactctgtcctccaggccggagtccagtggtgcaatctcagctcactgtagcctcaacctgccaggttgaagtgagcctcccatttcagcctcccaagtagctgggactacaattgtgagccaccatgccaggctcattgttntatttttagtagagacagggttttgccatgtttccctggctggtctcagactcctgggctcaagcaatctgcccgcctctgcctcccaaagtgctgggattacagacgtgagccaccacagctggctgaagattatactttcaattcagagcgagtttgaagatgacactttgaggcatcgtgtctatggttcattactacagaagcttctctggatgtgtaaagcacaggaaaccaggcagaggaggcacagggtgctctccagaacgagaagccagctcctggagttgtttgctgcaactgccattccccgttgatgaccatgctcttccttcagaagagggagagtgagaggaccaagtccaagtggttcccatttgaacatttaaaaaaaaaaaaaaggctgggcatggtggctcacgcctgtnntctcancactttgggaggctgaagtgggtggatcacaagtcaggagttcnagaccagcctgggcaagatggtgaaaccccatctctactnnaaatncaaannttagccgggcatggtggcgggcgcctaaaatcccagctactcgggagactaggcagagaattggttgaacccgggaggtggaggttgcagtgagccgagatcgtcccactgcactccagcctgggcaacagagtgagactctgtttctaaataaataaang

SEQ ID NO: 109283 - DNA, 546 bp, Homo sapiens
ctggtgcagaggatattgatttatatacattaaatctctaatgaattcctgaaaagcgccaggctgcctgagagtggtggggcctgctgggtgtgtacattcatgaaagtgctttttaatccttaagggccttgtggtgtgagttctggcctctaggctgactttgcctcgaggctaataaacatggaagaatgatgatcttcgaataattttataatccactgtgtgggactgttgaaacgactgcaaggcgatttagatgtaaataaacgtgatgttgcagaaatctataaataagaagcactggcaatttaaaccgtgttgtgcattttgccaaaaaacacgagtgagtcctggaaaccacagtgaggtgctgccgaaagtagagattctattttaaaaggtgcagccaccgttacagcacaaccctccgtgctcaggcctggccagcttatcatcatcactggatgtccaggctagcaaggacaatccctcttcccagtctcattttaattcctgagtcccatctgtaggaacatatcatct

SEQ ID NO: 109284 - DNA, 522 bp, Homo sapiens
aatcctatctcccagcctcacctctgctgtctcctccacgcttcctgtctccagagccccgagttcagcataagcagaaagcggcctgttccctctctagggagaggagggttgcggtctggaggtctggctcgtctttatctgcgcattctcccagcctcctggcttcagacctcagcgaggcggcggctgccggccggctctcctcttcctgcctgcagacctggcctgctgcttctttctccttcctccctccctgcctgccctgcggtttcaaagtagattagaaataacagtgtcccacatggaagcctctacttcttcctgggtcaactttgatgacgaggctccagaaaacctttgcaatgctgtgtggaatttttaaatcggtgagctcgtgctcttgccctatttatttgtccagcgtacatttctgaacattgtgaacgtcgaatgggccaacaaatctaaaaattaaatgagctgataaagaacgccgtcagcacagagcagacgctgggt

SEQ ID NO: 109285 - DNA, 704 bp, Homo sapiens
  misc_feature (219)..(219): n is a, c, g, or t
acatacaatttcatgggacttgtggactccttgggaccattcgtgaacctctgttaagaattcttaagttctttgcagggtcctagacaaagctctgaaaattgatatttttcctcagtgaagatcaactcaatcctaaaatggattttcagtttttcagctgaataaatcaacacccataggagcactttacagaatatggagacttgggagtctganggtgccaaataacatggaaatgataggtggagacttcttggggatgtgaaaggccttcctttcatgggttaagttcatcgggaatcattgctgcttcggtgagatttgaacttacacatttttctgtataggtctgaaggagcttagtctaaatattatgtaaatatgaccccatataaatatatatacacacacccacacacagagacactccatacataatgggatagatcccatggagcaaacctcaacagtggtgccgtgatttacaaaataacctctcagttgcacccttattacagtcagatcctcagtggcgggcttcttacttctctcagagtgaaattcactcttacacaggggcaacttgcagtgtgccacattcagaaaagctctttaaagtgtagtccctgtcatttacaaatgtgggctaattctcaatacctgtcgacctctatgttctcatccaaaatatggaaatcata

SEQ ID NO: 109286 - DNA, 298 bp, Homo sapiens
gtggaaacctttccagacccccaaagcaggtcacaggtgcccattgttccctctcaggaccctgtgctccctttctgtgtggcatggtccagttgtcattgtaccttaacttgtaaccctcctccccatgtcttttgtccacttgggttattctgcttcactaagtaaactggatttccctggctgttttttcatatgttcatgcctggaaacaactctcccagctctggctcaacatcatctggttcaaaagccataattagctgaccacaatctttgtgactgttaggtacagatg

SEQ ID NO: 109287 - DNA, 443 bp, Homo sapiens
accgctccaagctgagacactgaacattacaagtaacagcaattcaatgagctgacacaggaggtgtggcacttggagaacctggatcatgaagcagagcaagaccaggagagggccttctgaggtcttcctcctgcttaggggctcccatagggagtgcggctgcttccttccctctacagggtgaagaatcattcatccctgagcctctctggccagagcaatgtcttcaacagaaattagaagctttgtaacacaggaaatttccacattcaccttatatatgaaagtacctagcaaagtgcctgacacatattagtaactcaataaatgccagcttcctttcttccttcccaactctattttttattttctacatatccagagcataaatatcagggggaaaccaccaggaaatagaactggggatgaggagcggtgga

SEQ ID NO: 109288 - DNA, 243 bp, Homo sapiens
gagatagtgccactgcactacagcctgggcgacagagcgagactccctctcaagaaaaacaaacaaacaaaacagaacaaaacaaaaacttttctgcttctttcactgtagagagcagtagatctagaaagcattacatcactgagaggtttttttttctggtttcatatttttctctacttctcaaaaactgggaaaattagattacttgaagttcatctaatgctaatatttggatgagat

SEQ ID NO: 109289 - DNA, 385 bp, Homo sapiens
aattttaagacttgggtctgccaatgaatatgagctttctactttgcaacagaatgttaaaatataggtggaccaaaagttacactatgaagtagtgggttggaatatattttggaggtataatttcttttgaaacttaaattttatgatttttgatagaaaggcatttaccatattaaaatatattcccaattctaagaggagtgaccttgcatatagtacaagccataataagagtctgaaacagattttggggtagttgaaatttaatcttagaagtagcatttttacattattagaattacattgttgagtttttaaaaacattaactttttctgattataaaattatggtgctcactatggacaatttttggaaaataca

SEQ ID NO: 109290 - DNA, 390 bp, Homo sapiens
aatctgaattagttcagtctaagataacatagataacgcctacatagatgtgtttgaaaagtgatcggtccctatttccagatttccttgtgaaggcagtttcccaaggaactttggtcttcacagcttcctctgactgataaattctgatgctgtcatcagagatatgatattcaagatatgaatgcaaagataagtacccaaaaccttggtaaacagagccttaaccattatattagaagatacctaggaacattcagctctctattatgttatcaatggaggagagctctggttttctcaatatagagaataggttttgaatcaattctatcagtattagacttcaagccatgctctaaaacataaagggattgtaatgcaaccaat

SEQ ID NO: 109291 - DNA, 310 bp, Homo sapiens
ccacctgctgactgttgaccagctcctcttcctgtacccctctctaattcttcgctatgtaaacccctgactttagttggttagggagatggatttgggagcagccttccatctcccagctgacatcacctgtgttacagctgtcttccctggcaatacttattgtttcagtgattggctttccgtgagcaaccagatctaggccaaacctctaggtattcagcagcacatgcaaagaaacccaaaacaagcatgcaaagcgaacctatagcaccttagagacctttgggaatggggtacagagataatg

SEQ ID NO: 109292 - DNA, 286 bp, Homo sapiens
ctccagttgagcttttgcttctcgtaatagccagtccactcagtggagatttcagtttttagtgtttgcattgtatagacaaagggagcatctgtgagagttactcatgttctttaccttacaagcggtatttgtatcatggacgtggggcacacaactcaactggggtctccctgcccctggcaaagcaggaactcagcttgatacgacccatttccatgtcccccatttccatggtctttctagtgagtatccccacttcccagttttgcttctgatggctggg

SEQ ID NO: 109293 - DNA, 472 bp, Homo sapiens
cagtatcacacgggtcgagttctgtagctttgtagtatactttcaaatgaggaaatgtgagtcctctgacttgttctacccaactgttttttattaaaaattttttttcatgcttactgataacatcccatacttaactgtttttaaagcaaatttccctcttaaattttctaatagatgtgtaccaaattaaatacacctagcctctgttggaagaattctcctggattctagagttaggagagaagccctaagagtgttttaatactgagatatatggtccttcctatcaatatcttaaatcagggattgcatacttgatatactttggatatttgtccccacccaaatctcctgttgaaatataatccccaatgttggaagtgaggtctggtgggaggtgtatggatcatggaggtggatcccacatggcttggtgctgtctttgcgacagtcagtgggtgcttgtgaa

SEQ ID NO: 109294 - DNA, 258 bp, Homo sapiens
aagactacaggtgaaatatgtttggaagagaaagaacaggaggtcagtttttagtatattgagtttgagatgacactcagatagctaaaagtaggtgtcaaacacattaaatggatcataagcctgaagttcaggtaagagaggtaagttgatcactttggtatttaaagacataacattgatgaaatcaccaaggcaataaatgtagatagaacaattaaaaggtcaaggctgggtgtggtgtctcacgcctgtaat

SEQ ID NO: 109295 - DNA, 365 bp, Homo sapiens
gatcaaagacagaccactcagtcctagattggttcacagtctacatgcttcacatcatgttttgctaagaaatttgaaatctacatgccttctaggtgcagttcagaataatttccaaaataaggattttaaatggcaaatggcataaatacccgacaacagaatgagtatttaaataaattataaggaatttggtatttttaagtaaatatataaatggaatatagttactttaaaatgcacaaacagaatataaatggaaacatatattaagtaaaaaagaaagtattctgcccatcacaaatgtaataaatgaataatatttacacaaattgacaaagatgagaaaatgttgctaatacttc

SEQ ID NO: 109296 - DNA, 793 bp, Homo sapiens
atagaactgttaaacaagttcatcgaggttgcaggatacaagatcaatattcaaaaataaattttatttctaatacagtagcaatgaacaatctgaaatgaaattaagaaaacaacttcacttaaaatagcatcaaaaaacaataaaatacttagcaataaatttaaccaaagaagtgcaagacttatatacctaaagctacaaaataacattgaaataaattaaagatgtaaataaatggaggcatcctgtgttcatggacttaatattgttagggtgacaatacttcccaaattgaactacgtttttaacacaatccctttcaagatcctagctgacagtttttgcagaaattgggagattgatcctaaaatgtatatgtaaatgtgagagacccataatagccaaagcagttttaaaagagaagaacaaatttgaaggacccacacttcctgatttcaaaaattactatgaagctagtgtgctaaaacaatgtgtacttgtataaaaacaatgtgtacttctataaggataaacatataggtaaatggagtagaactgtgatttcagaaataaacccttacatttatgcccaattgatttttgtcaagggtagcaagacaactcagtgcaaaaagtaaaataagttatttcaacaaatgttgttggaacgactggatatccacatgcaaaagaatgaagctggacttcttctcacactatacacaaacattaactcattttagacctaactataagagctaaaaatataaaactcctggaagaaaaaata

SEQ ID NO: 109297 - DNA, 724 bp, Homo sapiens
agatttctagagtattacctttacagttttccctcaactaaaaaaaatgtttaaaatactaattcattggaaagaattgaaacttaacttttcactttggttttcagacagaaaaatttagaaacacaaaattgaagaggattatagcagcactaacataacaatcatttataaatagataaataaaataacacttaaatctgttctgttagccactttcaaccagagattaacaagactatttcatgtggctgacgagaattgacctctctatggtcttgtttaaaagtcttcttaaatagacgtatagaatcttaggatattccaggtttcttaatgttagaaacaatataattatgttggttactgtcaaaacttgcagtgttgtttgaaatatgtatttacagcaacagatagtcattgcgtctttcgttgtccacactggtaccagtttggtactgaggcatctgactaaagacctcagagaagcaccagaaaatggaaaagaaagatctgcccccaaatacgcagctggccacctttttgctactagtttactttgtcgcatataaaataacgaagacagatgcatgtcaaaggatgtgcgtattgggtcagaataaaaacatgcacaattttttttatgaggaacactcgttttatgaaagttcacaggctcttattcacttaagtctttagaaatttgtgtctctttgtctttcac

SEQ ID NO: 109298 - DNA, 206 bp, Homo sapiens
  misc_feature (110)..(110): n is a, c, g, or t
gatagtaactaggacatatggtcagtaagtggcaggtctggcatttatgcctgggtctgagtcaaaatcctggagcctgcacagagggagccaagtgatactgttcagtnttagtcctcatactcactaaaagctacacattagcctttaagcatttactccaatagtattatatagttgtaccccctttctgctggggatatgtt

SEQ ID NO: 109299 - DNA, 410 bp, Homo sapiens
cgacctcagcccggcagtctccttgcttcctcgagcgtccctttgctccggcattggggcggctgcaggacaccagcaagaacatcctcgagcacactgttgctgccaccatgggtcccacacactgtcttgtggccgcctcaggctcccgtcacgggaggggtgcacgggcacatttgctgaggtcaggaacggcgtgtgggaaggtcaccgagtgcctcccaggctccctgggacatgggagccacacgcatgttgggggagaatgtggtagtggccactggggacagtgtcaggagtgatggcgctgggtcctggctgtgaaggatgctgctttcgaggccggcaagcgtgtttaggtaacggcaaagaggctcgcggcaggtgctttcaaggcatggttttctaga

SEQ ID NO: 109300 - DNA, 364 bp, Homo sapiens
tctataaatatctgttagatccatttggtctatagtgcagattaagtctgatgtttgttgattttctgtctggaagatctctccagtgctgaaagtggggtgttgaagtctccagccatataatgcccttatttgaatgatatgtgctttctaaaaatgttgtgacctgctaaacatgtattatcactaggctatcaggcatacattagtctttattagaataaaacaaaatttcataactgtggctatttgtctttggtccttcacagggcctactctgtcccggcttcctttctgctgccctgatgtctcactggcttctgaatgagtgactgtgtaaaaataagttggtcttaaaacagta

SEQ ID NO: 109301 - DNA, 385 bp, Homo sapiens
tctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgtgagttccctgacatccctcctatactgcctattcc

SEQ ID NO: 109302 - DNA, 478 bp, Homo sapiens
tgtgccaccacacctggctgattgttttttggagaggtggggtcttgctgtgttgccgaggctggtctcaaactctaggcctcaagatcctctcacctcagcctcccaaagccctgggattacaggcacgaaccaccacacccagcctgcaagtgtcctcttaagccttcttgtgtaactacactccttagagaaaaatcttgctagttttctccattatggccagttttcaggaaacttttgggttattgatcatatcttttattttgctcatagaggtgtgatcttatttaaaagtccaaacatatagatggtccccaattttggactttttgactttttgatggagcaaaaacgatacacatttagtatgcacttcgacttacatccagataaacccactgtgagttttgactttaagatattttcaatttatcatgggcttattgggactcaattattgttattctcttaaaaa

SEQ ID NO: 109303 - DNA, 611 bp, Homo sapiens
gggggctgcaattctgcctaccacattgacttcatcagcaacaggtccagttcgggatgaatcgcctctgaagggtgctctgaagtgctccagctgaagttttggccatctccgccagccacaccccactgggttcctcctccccagctctggctgtttcgtcccctctagccatcgcccaccgtccacactgccatacggccgctcaggacatcccagttccctcctgcccgagagctctcatctgaggacgcgcatcattcctcaggaaactctatctttccacaccacccccagctgttctcagccacccagaaaaaaggaacataaacgctaatggggaaaaacatggggacacatctcatttcaccccacactccctcagctcaacctgggaatgtaacctgcagggcagcaagaccagaagcaacaccactccagttctcccaagggccaatggcatagcccttgggtattctcagggttctcttacccagacaggtggccagctagcaggagtgcacacacttccaaatatcagctaaagtcaaatgatggctcaatcttctccatctattaaatcaaattggtgctaggctcaatggccaagg

SEQ ID NO: 109304 - DNA, 306 bp, Homo sapiens
cctggccaagacctcatgttttaaacaaggcattatctattctcattctagttcctacttttctcttacaaatgcattcactgcaagttagagaaaaaagagtaacaagagtataatactataaacctcgggtattaattctagatttccattctcatatagcattcagaagcattttcacaagctggaatataactgaatgaataaagataatccttcaaaacctgtttacatcctcaaaaaggacttaaaggcttcctttggccatatttcagaccaatggctacatagagggaaagttggttt

SEQ ID NO: 109305 - DNA, 349 bp, Homo sapiens
gtgaaaggtttccttctggcgggtaggtgttgtggtgtttgaagtgagataattctctctagttcaggttcagattaaaaactcatttgacttttccttggcacttcattttgaaagtttattttagttgactagttaactagtaaaatatttagtgatttagtgatttctttaacagtactatactaatgttgatttgctaggatctgtaaatgttcattttaatgtatttatttatccatgtaaacagtaaagaatctatttgtaaccatgtcaaactgtaagatgtaaaactcaaaaactgagaaactttactttgctattttgtccctaaagttgaacatgtctg

SEQ ID NO: 109306 - DNA, 303 bp, Homo sapiens
aggaaaggaaaaagaaactagtgtgacgaacttggctgtcgctttaaataagttgctgtcttcctctcctctcacaaatatggttgtgatttaagaggagaactttttttcagacctgacttgtattttttcacaccagtacaacaatttatggggcaaggtaggccctggggaaaagtgctatgttatataaacatatgttggcctgcttttccgactcgtctaaatgatgttactgagtattttttgaatttctaggagaaaatagtttagccaatgattaataaaccagattaaaaaata

SEQ ID NO: 109307 - DNA, 356 bp, Homo sapiens
gttgcaatgttacattcctgctgcctggtgaaagcactccaacaccaaatctgcagtgtttactgcatgaagaaatgttgatggaatgaagaaatgattgtactctactatagcactgatcttgctttgacccagagttgtttttggacgtagagttgctcgacatgctaagttataaactcctggaaggcagggtccccccatcattcacctttgcatcccaccttgttccccagcacagcccctgacactgagtgggtgctttatcagggttctttggtggagtggagtactcacccgtcaacccagtcttgaagttcacctttgagatattagggaaatgagccctagcactt

SEQ ID NO: 109308 - DNA, 363 bp, Homo sapiens
ttagaataaggtggattgggaatttagtcacagttttataataataagtcatgtgtctaatttaatgtattggggaatttttttttccatattaaattttctagcattcttcagtctggttctgatcagtgtattattgtggacaggaatggtagtgtttaggagcttggaccctggagtggaactggttggatttgaatcccatctctatcactgctgtgtgacctcaggcaacttacctaactttcctggccctcagttttcctacacagaaaatgggaataataaaagtatctgcttcataggattattacgagaattcgctaactcaatatatgcaaatctgttggaccagtgcttagc

SEQ ID NO: 109309 - DNA, 401 bp, Homo sapiens
  misc_feature (15)..(15): n is a, c, g, or t
tcgagtcggtaccgngcactctagtccagattaccttggagcctccttcgtcttttccttcctcttcccctaccagtccacaagccactggggtgaaattagccacctgaaaaactcacctaatacgcggtctgatggtgactagagtggccgcggattctctaaattcgtccagtatgcttgcgcgcatggaactggccgtggtgggcccccggcttggactggggggacctcttgatctgcagtcaaatgcctcccacagccacttcctgagccagattaccttggagcctccttcgctccttttccttcctcttcccctaccagtccacaagccacttgggtgaaattagccacctgaaaaactcacctaatacgcggtctgatggtgacttgagtgg

SEQ ID NO: 109310 - DNA, 443 bp, Homo sapiens
ctgagcaatgacgggaacctgtgggcagagttcatttcttcccctaagaggagctgaaccagagtgactaaaggaccgctgagctcccttccaggattcccagtccccagccccccaaacaccaggtgaagtctccacgctcttacctcccagctctggagctgtgtgacccacaagctcttacctcccagctctggagctatgtgaccccctgaagcaggtctaggtctggcccctccctccactcagactagcccttccctggtgccttcgttggccacagcttctctgactgttcccaggtctcagttcactctgcccctgccctagggagagtctcccgtgagtcaacaggttcactgcatcctgaataagacctccctggatcagcattggagaatttccaggatctgacccagacccattactagccccatctccag

SEQ ID NO: 109311 - DNA, 414 bp, Homo sapiens
tgaattcaatctccctcccctattacagctgtcatgactcactgcaattgtgcttaataaacttttccttgacattcttaacaagtttccagtgcaatctctctttaacagggaacaaggctgtaaacttgagaccctggttcatttatctgaaatgcataggggatgacaggctccctcccactggggatgaaggagctgggaaccacacatgccattctgctgggcccacccaagtctgaatccatggagggggagggtgtcctgagagtacctcccacccacaaacccaaaacaccaggctcagatttctctctggatggccactccctgttgtcaccccatgatctgggtgagatccaggattgcaggtgcacaactgcccagagagaggtccaggaggtagactgcctc

SEQ ID NO: 109312 - DNA, 774 bp, Homo sapiens
gtttttccctgatgagcctgaggaacaccctggtgacaggaggaaggtctcagcagcacctggtaaaggactgcacaggctcttagtcccctcacatccagtcagctcagccacgtagtcagggccagggaccgtctgggcaagatgtgggcctcagcgcccatgggaagggctgtgcgacagtccctgggtagctcagtggctcaccacagacacagagctaccagggccgtactggtctcatcccaaacccttgtctcccttctagaatcagccttgtctcctctggtcaattttaactaaattacactcaaataagttccacagtgtggaccttttttaggcattagtgactggaagagttttgttctattacttcacattttcctaaacccacttaacacggatggaatctcttgtaatcctgtaagaccaaacacagaagaggaactgcgccaaagcggtcaggcccagtacttgtttagcacagacagaatggtcatacttcttctgaccttgtgataaatcttctgtgctgaatttgggaggtcttcacactgaggagtgctcatgcttcattcattaacagaggctgcttgagcatctactgccagccaggccctgtgccccgcatgtcacctcccttgtcaggctctgcctccttcagtctctgtcacaattctgtggggttagctatagcatcttcatatttagtactgaaggaactgatgctgagagaggtgatttgtctggtgtttcccaggaaataagtga

SEQ ID NO: 109313 - DNA, 778 bp, Homo sapiens
gactggtggctattgaaggtgtggcatctgattcatgatgagaaaaattggggattgttctgggaatagttgagctggtctctgcaggatgagtgagccatgtggttcttgtctctgtttcatgtggggacttagtcagtgttgggaatgttgtactagtatctgtccccgaaatagtgaccagtggggtcagtgcatctagttcactaggtgagatatttgttggaatggctgagctgacgtctgccccatgactggtggctgtggaagatacagtgtctaattcactgtggaaaaaattgggggttgtcttggaaacagttgggatggtctctgcaggatggataacccatgaagctgttgtatctggctcactagaagaaacatctagagtttgaataaccggacttctctctgccccagaacgagagaccagtgaggctgtggtctctgattctctattgaaaacagatggggttgtcctgggaagagctgtgctggtttctgctcccaggctggtagccaatgaggatgtcgtttctggaacatcagggaaaacatatggggttgtgatcatcatttctgtggggattgtgctggccatttgcattgatgcattgaggggagtcagtgttcccaaagtgggagtatagacactggtggtcaaggtggctctggaagtggtcttcagagctgtggtggtggtcttcagagctgtggtgtggtctccattctttttgtccctcctgtgtgtagtcctgtaaattggggaatgggc

SEQ ID NO: 109314 - DNA, 252 bp, Homo sapiens
ccagtaactcagctgcatcagtcaccctcaaggagatgagccatgactttgttcattagttggaaaagagtctggagagtgccttttcgttactgtttatctttggtctgacacttgggaatagggtcatggatacttcagccagaaaactttccaaatttaagttattaatgtattataaggatcaaagtttctagtatagcctgttcaattagaacatagtgtgttggttgattggatttggagaaaggg

SEQ ID NO: 109315 - DNA, 442 bp, Homo sapiens
gatggaggaatggataaacagcacgtggtctgtccatacaatggaatatgattcagcctttaaaaggaaggagattctgacccctgctacaacactggggaaccttgagcatattatcctaagtgaaataagccagacatagaaagacacatactgtaggattcaacttctgtgaagtgcctagagtcgtccaattcatagagacagaaagtagaacggtggttgccaagggcttggggaaggaggagaaaggacatctatggacattttgccatatggcataatgggtgcagggtttatgtttgcgggatattttaaagttctggaaataggtagtgctgatggctctacaacattgcgagtattctcaatgccgctgaactgtacatttaaatgtggttacagtggtaagcctcatgttagtatattttgccacagttga

SEQ ID NO: 109316 - DNA, 330 bp, Homo sapiens
cttacaaaaagaaaacccctcctctaaaatgtttgagtccttcatttgtccttatttaattaaaaataattattgagcatatactacattccaggcaccatgctaaaacatggagcacgggccagtcatcaaaacagacccaaactttgctgttcaaggaacttacagtctattgaacaatgcgaacagtaaagaagtcattgcattattaacaaatattgtaaatgaacttcaaggtgctgagtgtcttttaaaaattatttctcctaatgctatccctcccctatcccccaccccccaacatcacacaccggggcctgtcgtgggttg

SEQ ID NO: 109317 - DNA, 293 bp, Homo sapiens
tgcacatgaacttttcagattagctatctgttggctttaataatgtcagcataggctgggcgtagtgcctcatgcctgtaatcccagcattttgggaagccgaggctggctggtctcaaactcctgacctcaggtaatccgccctccttggcctccctaagtgttgggattacaggcgtgagccaccgcacctggccctttttttttttttaagacagggtctcgggctgtcacccagactgaagtgcagtggcgccatcttggctcactggcaacctccccaccagcaacct

SEQ ID NO: 109318 - DNA, 744 bp, Homo sapiens
ataacaatgccacatgttgcttgtgtgataaataatctttgtttactgtggacacttcggcaatttggttcatcttggtacagaaaatacaaagacaggactaatattttattcattttttatacttagtaactaggacagggatctgtatttagactatattcaagcctcgctctgtcacccatgcttgagtgcaacctctgcccactgtgttcaagcgattctcctgcctcagcctcctgagtagctgggagtacaggcgtgcatcaccacacccggctaatttttgtatttttagtagagacagggttttgccatgttgaccaggctggtctcaaactcctgacctcaggtgatccgcccacctcggcctcccaaagtgctgggattacaggtgtgcgtctccgcgcccggccagttacataagattttaaaaaatgtattgtaataggctctctgattgtttagaaggtttcatgttgtgcccgcagtattttcatccactggtaatcactttaggtaatcaaaactagttcagacttttaaaataaatagttgcttggtgacatgataaactaataaatgttattcttattggttaatatgaaacatctatcaaaagtgaaaaaagaagaatgcagaatgtttgtaaactgattccaaaattacacaaaatagcaactgtgaaaaaaatgaaggcaatatatgaaaataataacagctatgtggcataattatggggga

SEQ ID NO: 109319 - DNA, 372 bp, Homo sapiens
atgagccagctacctcatagcagccatctcagcagaaaaggactgagcctctcctgggcctggagcttccaatccctgtggcctcctgctcccctcactggcagaaagccccagtattcactgggatggggaagtccccatgctaagcctagcctcccctcttccctgctctcacagctctctatttaatagcagcaactaataattatttgcattgtctcagtgaatccccagaacagccctatgaggttatcatggccattccataggcgagaagtaaggcaactggacctagattaggggatttacctaaaatgacaactagcaagcagtagagtcaggactcaaacccagacttttaacccccatgct

SEQ ID NO: 109320 - DNA, 258 bp, Homo sapiens
atgagccagctacctcatagcagccatctcagcagaaaaggactgagcctctcctgggcctggagcttccaatccctgtggcctcctgctcccctcactggcagaaagccccagtattcactgggatggggaagtccccatgctaagcctagcctcccctcttccctgctctcacagctctctatttaatagcagcaggaggattccagcagcaggagaagcagcaggagaagcagcaggcaatcctctagatcacct

SEQ ID NO: 109321 - DNA, 1205 bp, Homo sapiens
ataattcagctcttttgagttatgtggggccagcagaagtctcaatccttataggcttgatggtgagagcagcgggaggtttgaggtgtactcattgcagtccagtttggtctctaaataggatgcttacgagaaatcagtgaaggtaagcagggctgccactgtggccacgtaacccttcaggaaccagtgctgaagaataatgagtgagaacacttaatttgagagttagacaaatacagcccactttggatttcatcctagtgaacagactaaaacttcgcagtaaaatacctatttctacaaagcaaggtttgcctgcctcggttggggaaacctagtggttttgtcacactagtcgatgtatgatgttagtgttgtaagacaccatggcagaatcttcattattctcacctattctgaaccctgcgtcatgtatctgggatgccccctcccaagtccaccaatgtaccacgttgctgacacagccttcatttttaactcaaattgatgctcagtaaaggtcaatgacaatttgttcaaggaagttcatctaaaataatctggaggccttgaaaatgatccctctaaaatgctgttgagcttgtgttcagtgtagcaggaggatctgaacttttcctggagaggtggtgatcgggatgccatttggcagcttaagcacatcctgccagcaggctttaagtggctgttctaggcatagccctccctgaactagaaaggagagtaaccagtttgctatgctgcgtctaaccagacacacctgacttagtagtaactctaagaacccttaacttacaaacaactttgtctcctcttagacaatattcattaaatctgaggacacagtttgacagtagttcagattcttgcatgagcaattgacagcatcagagcacacaatatcataagttacataaattacacaaagtacatcataaattacactacagacacgttaggtaaaaagcatcaggccgggccgggcgtggtggctcatgcctataatcccagcactttgggaggccaagcgggggcggatcacgaggtcaggagattgagaccatcctggctaacacggtgaaaccccatctctactaaaaatacaaaaaattagccgggcgtggtggtgggcgcctgtagtcccagctactcgggaggctgaggcaggagaatggcgtgaaccc

SEQ ID NO: 109322 - DNA, 273 bp, Homo sapiens
gatgaaaaactgcagtaccagtttgaggggctactgtactgttttatttcaagtcttagcaacttcttaacactttgcccaattcacttcacaacctgtttcaggtaatttgactttttagtatctcctatactttcttcctgtttttctcaatgttgagagaaagagacttccttattcatttctactttgttgtttgcattccttctttttttattttattttatttttttgtctatatacaactaatgtattttgttatttttttaatta

SEQ ID NO: 109323 - DNA, 175 bp, Homo sapiens
ggacagggaggacttggtagcagcacatagaaggaaaaagaattactgcttgtcgaaaatttcagcaaggctcccagaggtttacttacatccctaagactcaaatatgatcttaaaataagcataacaatgtataataacaagtccatcaatcattattgaaaaaaatctttga

SEQ ID NO: 109324 - DNA, 840 bp, Homo sapiens
gagtgcctcctaagtggatgccctccacacctcctgcacttggccctggccctgggtcctaggctcattgttgatcttcttagatctgggttccttgcattgcaggacctacctcagcctgctcttgtctgcctttgctgatgcccctcaattcacctctttcctgcctgtactgtgatatggtgtgaacttgacttatactgcttgtgaaacctgagtcatgtgctgaaatcctgccccgccaccgctttcctcccttaactggatccttagccttggactccaaggctacagctctgtctcgtggccactcaagccccacccaaaggaggtgctactcaaaagtttgaggcaggagtgatttatcgtgaatgacaatgttatagtttctaattctagtgtttagcatggtattattcacttatttattttaaaatcttagacaatttatctaaaatgtcaatttttagaaggtatcagcacaattgtggcagccttttttctgtatgtgttatatgtattatttaaaaaagcaggttcattctatgacaggtattggtttcggtattcacaatataaattgtcttttcaagggaaaggatattttctttggaaatgtcattgaatctatgttctctttattgaaattgttctaattgactttgaactgtttctcagacacctggtgcccagtttctggccatagaaactatgtgaggctgagtaattcatgttttgggtcactaccagtcacgaatgcttctctcattccaaggctatgcatatggatgtcacattcccatgtcaatcatctctggaaggtattattcgcccagtttt

SEQ ID NO: 109325 - DNA, 324 bp, Homo sapiens
acgtgctacaaaaatgataatctcacttattaaagctttgtttacagtgttgatagctcttatagtacttttgcaaatctttactaatttaacattacaacttcctatcttttcctaatctcatgtaatttaccctacttaattccttgcttctggatatgctacatttgccacccaatgagtttatttcactggtcatttacttttaacagtaaagccaaactatttgaaagaaataatctcccaacaaatccaacacaggaaaaaaagactcttatttatccagcattttgtgccatgaattgaagttttattgcaaagagt

SEQ ID NO: 109326 - DNA, 556 bp, Homo sapiens
tctgggttaagtgttgatatttagacttgttaggagtagaggtacaatgttataaagaaagagactttaccatctgtatactaactaaaaacacaaatacatttcaggaatgttggtggctattggtggctattttcattgtatttcatggttctgtatgatatggccatttatgtcatcaggaaacaagctgacaggtcaatgggttttttttttgcgtctgtaaatgacatttaatcttattatgtaatataggaagacagaaagctttttgatgatactgaaatccttccatttattaatagctcttgcttataaccttaaaaaatatgcactgtctttctggtttagttttctaatacttattttcctgttctttaaaaaaatttttgtggacatttaaaatcatctggtaaaattatgactgttcttttaataagtaacatattaattgtagctcgtagcagcagttttacagtaaaggaaggttactgtgaaactgctcgattctgggaagatataatgttcactcttgttttgcttagtagggacggca

SEQ ID NO: 109327 - DNA, 132 bp, Homo sapiens
catgagttgaggcttggagatgtcatggcagtcgctcgaggctccacggcttgtaaatgatgggacagaaggcatccccagtctgcggctctacagctcttgtgtttccaaagctgacccagccctttggtt

SEQ ID NO: 109328 - DNA, 383 bp, Homo sapiens
gtacattttaaaataacaaacacccacatttgtgtttgaacccagataatactaatttttctccactgagagacccaaggtgccttccctgagctgcacagatacctccttgggaggtacgttaggggcccagcagatcccatctcagaatctcaccctaccttggtgtgtccagactgtcggggagaatatggagtgagaggtgaggcccagccagatctgaagcctcacccccacccatcatctatcctcctggcatctttcccctgcttctggtttaattagttgttggattgatctgctgaacccagaggggttctagagcagttgctttattccatcttcagctagcagaagttttgaaggatattgggtcggggtga

SEQ ID NO: 109329 - DNA, 639 bp, Homo sapiens
ccccaaactctcacctccttaaggaattgctttgcctaatattaaccctttccaatcttcatctgtagcctcaattcatcttcacagcaaccccgggaagtagtgctgtcctccccatagaggcgcagaaacatgccttgcctcattcagttcacacgactggaggtgtagttcagttcttcccattttatgggggaggaagcttaagtcccagtgaggttagtaacttgtcagataaaggatgaagccaggaatcaacctcagtcccaggcctgtgactgtgaccgctgtgctaaccctgtgcctggcactcacacacaggcactcgtttatttagcctctgggcaaggaaagcaccatgactgtcattttacagctcaacctgggcttggaaagtttggtggttgccgaaaggccagacaggcagcaagtggaaagcccataaattttctaccctggcctcctcaagaatggttatatgcagaaccgtatgcttagcgcttactctgtgccagcctgagctgggcacctcacacgccttagaacctgaatccaccccacccccaggaatgttctgcatcctgccacaggcggactgtgctgcaggcacagacaggggaccatggggcctcttagcac

SEQ ID NO: 109330 - DNA, 268 bp, Homo sapiens
accaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggca

SEQ ID NO: 109331 - DNA, 750 bp, Homo sapiens
gttgattataaatgttattcttgagccccaccccagacttgttgaatcagagtctctggaagtgggaatgaggatctagtcctttaacaagactcccaggtgattctcatgcatgctaaagttcaagaattgctgctaatatactcagtcatctgttccctccccataacccaggtagggaaacctggcctggacttcttacactagaaccacctccagttatatgagcttgtctcataatttattcttccagtaaaaactgttcttcaaggtcattaaaaagatacttcttttcactaccattgcattaatctctaaagctgtattgagatcttgtcatctgccaggcaccactcatttatagatgttctgtcatggatccaaagattgtgtgaacccagaaactgcctgtcctgcctgccttccccaccggtggcctggaaaacccccttccctgtcctcctcaccccctatctctgcatcttaggtcctgccttgacccagtacagccacttaacttcccaacaccatgggcttctgtgtacttcctttccttttatttgaaaaaaacaaaaactgtaggctaaaggagattgtaatagattttacgcctaccagtggttccctggtcatgaagttttacaagcattgagataaataaagctaaccaggagctatagaaattctcagaggcttcaaattttcatgtccattgccaaattccaaaagagaggtatcataagcttcata

SEQ ID NO: 109332 - DNA, 851 bp, Homo sapiens
tgggttattaggaaaagaatttttatggaaaaacattgaattaagctagttactgagataaaatgtgttgctgtctataaaattccatccttggcacaggtaccattcaacctaccactcctttcaattataatatgttttaattagggcaagtagaatggaagtatatgtaaaagtactacgataaagtgtggcagacactgtattgagacataaagaaatatcagagactggggtaaattcttgccaaatcagatgtttaaagtaggcgtggtggagacaattagtgctcatcagtatctgttttctcttcttcctgaggatgcagtcagaacaaattgaaaaggtaactaataaaagggggagagaaagaaaaataatgcgtgtgtttgtgtctcctgctgattacagttatgctctcagccatgtcaggactggcgcttaacgtggctccgagacattcctagttatagccaactgacgcaaccacctcccttcagctgttttttgtcttttcctccgcaaaagatcacaattttcttgggcctttgcctttttcagcaggctgtgaagcttgaaatttcttactactgcatttcagttttatctggttctacttaattggggcaagggagtagagttaaggttaaatacagaatattatgtgatctgttcctccaattaaaataaattgcactctagacacaaaacagtaaaaaaaaagagagaaaaagtatgaaatggaaatgccttcctacacaatccttctttctttattgtgaaatattgtacatattgttaaaacaaaatgtttcataatcttagataatactaaatatcaacatatattt

SEQ ID NO: 109333 - DNA, 3768 bp, Homo sapiens
ttccctgtccctgcttggtggagctgccacgtgtggttcagttctaagttctggactagtgccactcgatatcattgggaataaatcgttgttcaacagtctgttccacaaacaacagtaattgaatttcacagactttatcctgattagtggaaatcaaataatggagtggaatccccatgtgttttctcttgcacaaacttattagacttgattagaaaactgtttggaggaaaaacttgccagtaagttttttggttgttgttttgttttttttgaaaaacgacgcaacaccataaagtgtaaaattaggggttctggccaagagaggtactagatttttttaatgccgagaaaagtccatgccacagaagttattgtgtatgtctctagggagctttaagaatttcacgtttgaactttacagctgtttaccaattaaatggcaagctggaaaaatacattttgagaggggtagaaagaataagaatataattaaaagtatgctaacaaaataagcagtacatatttttttagaaaatgcagtttaggccaggcacggtagctcgtgcctgtaatcccagcactttgggaggccgaggcaggtggatcacctgaggtcaggagtttgagaccagcctggacaacatggtgaaaccccgtctctactaaaaatacaaaaaattagccaacgatggtgatgcctgtctgtaatcccagctactctggaggctgaggcaggagaatcgcttgaaccggggaggcagaggttgtagtgagccaagattgcaccactgcactccagcctgggcaacagagcaagactccgtctcaaaaaaggaaagaaaatgcagtttcattccagccatccctagatttcttttccccttaaagtggctgaatccattggagatgtgatttattttgcagatccaccaattccaaacttcaggaatattcaagcgggagtcatgtgtaagtgacagctttgacaaagagagactgtggctgggtggcccgggtgttgcccacgcggagcaaggattggttcattcaacggatggagagtacaggatggctgggacctgggaagttccagaatctgaaaagagggcagggcaagaaggagccagaagagaggtcccacccctcagttggcagtggggcacggaggtccgcatcagccaagaacgtccccaggatgccgtgggcacctcatttcaccccacgtttttggcacagtctactttttaggtattttgtaaaggaacttctcaggattgattatttgccagaggaacaattaggccaagagaaacttgcttgacagccatgtgtaaaacacgtctgtcctaatcaaactagagatgcctcaaggcccacgcaggacacaggcaggttcaaggtcatgcacctggaaatttgtaggggagggtcaagcaactgaggccaaagggggccggtaaagtggcttctggggtctgagcatctggaaggctcctggcagcagttacctgacagtgtcgttgaggggcacggcagctgggccctcaccgtttccgccagctctgctgagccagcccagcccatgcattccgaacatccgacagcttctttctccagaatgtcttctgtcagagacttccaggaaaggagctccctcctgtctcactgctgtcagcgtgggagccctgctccccaggctccacgtccccggaaggtccatcttgtcctggagcacacccagccccattcagggtcagtgcaggagggaacagggaatctgcatttcagtaagctccccaggtgaggctgcagagcagaaaccacggctttcagacgtgagcaggctccctgggctcttggtgtcaccctgttagccacatctgcggaatgtggaaggcagaacatagccacgctgcttagtgctgccagcgaacctcaggttgcatcagtggctggaatctatcacagctgttggggatacgtaactcccagcaataaatccagtattttcttccctgccctgagcttcctctgggtttcttatcagcagctattacacacagatgtccagtgcttctaaactaaattgtactgtgtaacttttacatcacacttgtgtgcttaaaaagcacaccgtgggtagtgactgggccaagagacatcacaaagcttcctgataaatttgaatccagccacggcaagagcgacgtgcgggtacctggtccctgatgcttgggtgccccgttgagcctcgggtacttcttggacactattgtgagagcagccatcctggtgtctctgccagcatcttggggaacgctgtgatggtaaaatatctgtctctcctctgggaatcagggcagccctgagaagtgagcagttccctttacagatggataattgtttgtgtaagaccaaccagatgaagtccaaactgtgtagaacacacgtgtgcctcacacatagccatctgagtaaaatattttttccaatgtagatttataattagaaatgacagatttataatatagacttcagtagggttgggcacagctgtcactttcgtggtatcaataaaaggctagaaaccttgagtgtccttggcaacctagcctttgacattgatgtttttccataggattttcttcatttgggttggaataaaaatgcatttttattcacaaggcacagacagataagaatatcataagcagggaagtgtctccaaaggtcaggacttatgtttttctgttgagtgctatatgtggaggttattgcaagttccctgatatgagtatggtttcgcttgctacattgtgcctattaaagtaaaattttacacaagcctcgcatttctaagattagtgttcccgaatgaaatgttaagaaaacattaaaagattatctctttttaagatggaggaaaaaaagtgaacaaagctaattaatctataatgaaaattgcacaaaataacatttcttaacaaatttaatacaattttgtgttctttgttgctagtggtataaaacgagatttttttccctcatttttctcattgtagatgtcatctctcacatttatatcagtgaggtttgaaattctgtgtagcagttactcagcacatatgagagggcagcgaatgaatgagatttgtcatgtgctaataaaagctgaatttttgtaatctaaaatgatgtattttctactattgctgttaatttgcattgttaaaaattcttaaagtttaatatgttatgttcagtcattgaaagcgaccactcatttttttcttaaagttgatgccttttctgctgtgctagagtcagtattttgcttctggcaggagagctgcaaactgtgtatcctcaaacagatgcaaaaagtagtgctttgcaaaacgtttgttttctgtttatctcagattaacatcctttaatacaagtttcttaagtgtaacttgtatttctgaaaatgcttaaaattattttatatttccctttgggaatttttctctatttccagcacgctgatttgatttaaaaatgtaataagaccaagagttggagtaaagggatattcattccatgttaaaagtggcttcatagctactgacaaatgtctgaactattgtcgtgcccttcaaaactggagttttctaaaataatcttatttttatacttgtatgttccagcaatttaagatatataccattgaaagggaaataaaacatttttgtttatttgaataaataatactcccaa

SEQ ID NO: 109334 - DNA, 625 bp, Homo sapiens
  misc_feature (625)..(625): n is a, c, g, or t
ttccctgtccctgcttggtggagctgccacgtgtggttcagttctaagttctggactagtgccactcgatatcattgggaataaatcgttgttcaacagtctgttccacaaacaacagtaattgaatttcacagactttatcctgattagtggaaatcaaataatggagtggaatccccatgtgttttctcttgcacaaacttattagacttgattagaaaactgtttggaggaaaaacttgccagtaagttttttggttgttgttttgttttttttgaaaaacgacgcaacaccataaagtgtaaaattaggggttctggccaagagaggtactagatttttttaatgccgagaaaagtccatgccacagaagttattgtgtatgtctctagggagctttaagaatttcacgtttgaactttacagctgtttaccaattaaatggcaagctggaaagttcaaacgtgaaattcttaaagctccctagagacttcacccgggggtgaaggggtaaacccgactgaaactggaacccttgtcctccgctggtgcgggatgacagagggccgtgaggggtccccctgcttatcttcacccctgccagaaccacaaatatcggggtcn

SEQ ID NO: 109335 - DNA, 3199 bp, Homo sapiens
ttccctgtccctgcttggtggagctgccacgtgtggttcagttctaagttctggactagtgccactcgatatcattgggaataaatcgttgttcaacagtctgttccacaaacaacagtaattgaatttcacagactttatcctgattagtggaaatcaaataatggagtggaatccccatgtgttttctcttgcacaaacttattagacttgattagaaaactgtttggaggaaaaacttgccagtaagttttttggttgttgttttgttttttttgaaaaacgacgcaacaccataaagtgtaaaattaggggttctggccaagagaggtactagatttttttaatgccgagaaaagtccatgccacagaagttattgtgtatgtctctagggagctttaagaatttcacgtttgaactttacagctgtttaccaattaaatggcaagctggaaaaatacattttgagaggggtagaaagaataagaatataattaaaagtatgctaacaaaataagcagtacatatttttttagaaaatgcagtttaggccaggcacggtagctcgtgcctgtaatcccagcactttgggaggccgaggcaggtggatcacctgaggtcaggagtttgagaccagcctggacaacatggtgaaaccccgtctctactaaaaatacaaaaaattagccaacgatggtgatgcctgtctgtaatcccagctactctggaggctgaggcaggagaatcgcttgaaccggggaggcagaggttgtagtgagccaagattgcaccactgcactccagcctgggcaacagagcaagactccgtctcaaaaaaggaaagaaaatgcagtttcattccagccatccctagatttcttttccccttaaagtggctgaatccattggagatgtgatttattttgcagatccaccaattccaaacttcaggaatattcaagcgggagtcatgtgtaagtgacagctttgacaaagagagactgtggctgggtggcccgggtgttgcccacgcggagcaaggattggttcattcaacggatggagagtacaggatggctgggacctgggaagttccagaatctgaaaagagggcagggcaagaaggagccagaagagaggtccccggaaggtccatcttgtcctggagcacacccagccccattcagggtcagtgcaggagggaacagggaatctgcatttcagtaagctccccaggtgaggctgcagagcagaaaccacggctttcagacgtgagcaggctccctgggctcttggtgtcaccctgttagccacatctgcggaatgtggaaggcagaacatagccacgctgcttagtgctgccagcgaacctcaggttgcatcagtggctggaatctatcacagctgttggggatacgtaactcccagcaataaatccagtattttcttccctgccctgagcttcctctgggtttcttatcagcagctattacacacagatgtccagtgcttctaaactaaattgtactgtgtaacttttacatcacacttgtgtgcttaaaaagcacaccgtgggtagtgactgggccaagagacatcacaaagcttcctgataaatttgaatccagccacggcaagagcgacgtgcgggtacctggtccctgatgcttgggtgccccgttgagcctcgggtacttcttggacactattgtgagagcagccatcctggtgtctctgccagcatcttggggaacgctgtgatggtaaaatatctgtctctcctctgggaatcagggcagccctgagaagtgagcagttccctttacagatggataattgtttgtgtaagaccaaccagatgaagtccaaactgtgtagaacacacgtgtgcctcacacatagccatctgagtaaaatattttttccaatgtagatttataattagaaatgacagatttataatatagacttcagtagggttgggcacagctgtcactttcgtggtatcaataaaaggctagaaaccttgagtgtccttggcaacctagcctttgacattgatgtttttccataggattttcttcatttgggttggaataaaaatgcatttttattcacaaggcacagacagataagaatatcataagcagggaagtgtctccaaaggtcaggacttatgtttttctgttgagtgctatatgtggaggttattgcaagttccctgatatgagtatggtttcgcttgctacattgtgcctattaaagtaaaattttacacaagcctcgcatttctaagattagtgttcccgaatgaaatgttaagaaaacattaaaagattatctctttttaagatggaggaaaaaaagtgaacaaagctaattaatctataatgaaaattgcacaaaataacatttcttaacaaatttaatacaattttgtgttctttgttgctagtggtataaaacgagatttttttccctcatttttctcattgtagatgtcatctctcacatttatatcagtgaggtttgaaattctgtgtagcagttactcagcacatatgagagggcagcgaatgaatgagatttgtcatgtgctaataaaagctgaatttttgtaatctaaaatgatgtattttctactattgctgttaatttgcattgttaaaaattcttaaagtttaatatgttatgttcagtcattgaaagcgaccactcatttttttcttaaagttgatgccttttctgctgtgctagagtcagtattttgcttctggcaggagagctgcaaactgtgtatcctcaaacagatgcaaaaagtagtgctttgcaaaacgtttgttttctgtttatctcagattaacatcctttaatacaagtttcttaagtgtaacttgtatttctgaaaatgcttaaaattattttatatttccctttgggaatttttctctatttccagcacgctgatttgatttaaaaatgtaataagaccaagagttggagtaaagggatattcattccatgttaaaagtggcttcatagctactgacaaatgtctgaactattgtcgtgcccttcaaaactggagttttctaaaataatcttatttttatacttgtatgttccagcaatttaagatatataccattgaaagggaaataaaacatttttgtttatttgaataaataatactcccaa

SEQ ID NO: 109336 - DNA, 825 bp, Homo sapiens
gttgtgtctcttggttcatgcattacttcattgctttgacatgacctatccttttttccttctccccgaactcctgggctccaattagaaactagctttttatcctaggctgcagtcctgcctaccaactttttttgtttcataccttctattctggagcccattgtacagccactgactttggagcctttactactccaacttggcttctgagagttagatttgtagatggcattgaattgggactcacaatgacagatgaaaaacttcattctgactttttaggccattggtgttaggtgctaggactgaaatcctagtatgtgaaagctggaaggggttttagagaccatctctcccaaacttcttatttacatatcagaagaacaaacttacccaaggttttggtaagccagggctagaatataattttctctgattctcattcatatgttgttctcactctgttgtggagcctgtctaccctaatggagcctgtttgggttgttaggaggtctgggacctacacagaggagaaccaggaagcagttcacaatattatattatgttcaccgaaattggtctgggtacaattagggatatacaaagtcaaatgtcaagtgctgcttctttggacctatccagctagaaagcttttttattaggcacagaaaaagaagcccagcaatatctgtttcctatggtgcctaatatatgcaccctataccactctcttgacaatatctgttcagagcaatgaggaatctgtttgctgggatgtacagtataggcatctgaaggagacaggtcagagccttatgttgt

SEQ ID NO: 109337 - DNA, 441 bp, Homo sapiens
cagctggattacaggcacgcgccaccacgcccaaacaattttttgtatttttagtagagacagggttttaccatactggacaggctggtctcaaactccaaaccttgtgatccgcccaccttggcctctcaaagtgctgggattacaggcgtgagccgctgtgcccggccattataactttttaagtacatcaaggagtctttcccaggagagatgaaaattcatttgattttttatatttcaaggtttagcagacaataaagataggcacccaccagttacataccgcagacttgtcaacatgcgtatgtattggaaatggtacatcctttggtgggttgaaaagggggttaagtaagagcaaggagcatacattcctgcaggcaacctcttcacagtcagagctggggctgctgcaggcaaccctggtgtccattactt

SEQ ID NO: 109338 - DNA, 533 bp, Homo sapiens
caagccctcttcagtggacttggcatactacagtcaggggcattttctgaaatgcaaatctgattacatcactcttggctttccttaaaaaccttcactagcttgccattgctcttacgatgatataatttgaaatcctctacctggcccccagggtcccttctcccatctgatctggcaagcccccactctgtgtgcctgctccctccctcattctttctttcatttccagcctcatcccccatttctctttttccaggttctctgttccctagttatgtggggcttctagattttcaactgtaccatactccttcctgcctcagatgctattccccagctgaggatattcctcactctctgctaatttaattcctcctcttctgagaggtcagcttcatgagaagttgtattgtgcagtagtcaagaatgtggactttggagctagactgcctgggatcaaatcctaggtctgatactttctactttggacaaattacttaacctctcagtttcttcatttgtaaaagagg

SEQ ID NO: 109339 - DNA, 674 bp, Homo sapiens
caggcaaacaagacccctttccaaagcctctgcgtcagagtgtccagcccgcgatgtccctgggcagggcaccccagtgtccaccgaacctcgagctgcctgctccctcccgcagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcact

SEQ ID NO: 109340 - DNA, 1619 bp, Homo sapiens
tcagagttcacgaggcagccgaggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacagggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaagctt

SEQ ID NO: 109341 - DNA, 528 bp, Homo sapiens
gcccacagagcttgatccagaagtgcacaggtaagtatttagcaggctggccgatgttgatttgaacaatctcaagaatgtgctctttagtgcattaaacatatgtgacgagagctgagcacgtttaaaatctcagtaactttggggtttgtaagtgttgtagctcatagtgtcggttaaggttagacatctcagtcacatgctgtcttggcaccagctgtggactgtgctgtgaaagagatctgtgaccttgcaccctgagatctcaggctcaattaagagacaaaacaggcaatgcagtatcagtgcagatgggaaagagaaagcagaaagtatgaagagggaaaggaggagcacaaaggagttagcattagtctctactgagcaattcctattccaaccacgtcctaaatgatgagttggatcctagcagaaagggaacacatgttatttttaactgattttaacttgatttattgtaacctatcaggagctcttaataaatatggctctttatgttgttagcaa

SEQ ID NO: 109342 - DNA, 515 bp, Homo sapiens
acttcctttgttagcatttttttttttcaaaataattagcttggaataattcttaagccaaagggacatattttggggttgcatattctggtttcctaccattatattttggggtggcatattttggtcttatacactgtgttccaccggcaatgaaaagagttcttgtttttcctccagcaatttgtcatttgttaaagagtttagcagttctaagagatatagaccagctgtgctatctttttgtggttttcagttctctagtatgttgagcatctttttgtaagtgtacttgccatctgtagatcttctttggtgaggcgtctgttcagatctgtgtgcatttttaattgggctgtttaacttattgtttagttttaacaattttttatgtattttgaatacaaattctcagatctgtattttgcaaatattttcttcaatatgtggcttgtcttttggttctcttaacaaggtctcttccagagtataaactgtaaataataagaaatcca

SEQ ID NO: 109343 - DNA, 448 bp, Homo sapiens
actggcccaaggcacgaggggagagctcatgccagatccaagtgtgggtggctggagtttgcagtgctttggaggaataacgaactggaactctggggaaagctctagacagtggtgagtggtctgcaggtccatcctggttggcaggttgggaagagctgggcttgccctgtgaggttggctggtgtgactgcctcatcagggcccctccccattccatcacagtcactcacctagccttgggtctcgcctgccgtgctgtgctgtgaggtggcctggtgctggctgtgcagacgccctggcttgctgcactccctggcagagtgctcagaagcaggaaacagacaagaggagcgccagggtggcccggccagagcctcacaggccttgcactctttgtgctggcctttccactggccaccttggctgtggcctgtgacttctagta

SEQ ID NO: 109344 - DNA, 249 bp, Homo sapiens
tatttcctgccttgagtcctttgctgggcttctttctcatttattcagctgtcactgggcatttccacatcatgttcttcaccaatgattatccagaatgagacccctaacaatacctgcctcctgttcctagccacagacctgctgctctacctgtattttctctccacacagatgtacaagacagaaaccttacagtcatctctgtcactcctgcacttccacattctcccacatccatccaaagga

SEQ ID NO: 109345 - DNA, 926 bp, Homo sapiens
gggaagacccgaagacagacattcctgttagtcccactttttctttgttttctttcaaacaagcagggaagtgaggaaagcacaggttcagttttaataatctgctaacatggcacttgtctgggctgttacccatatgggtcaaaccatgtctgtcctggagtgtgcttgaaattcacccagtgatcacagcatgcagacacgttgaaattggcagcatctctgagcatttctctggctcctgctgcctagtgtatacctcttttgccttgctgttgggtgaggcatgtttcaatctacttgttttataagactagacaatattcagtaaaatgggccaccccagagcttagaacagaagctctgggaaaaaaaatatctaatacgaggaagtattcgttgtgggggaatgtcaatttaaataatttaacatgtaaaatagtaattgtcttaatttaggctataacgtttttcagtaagcattttcacgttagcttctcataaatcttagtttgttcacttagaggtcttgatgttcttattaatttcgatacattatttacatatataatttcctgtctgcttcctttgaagtatgtgattttttttttaattgtagaggagacacagtttctgtaattatacatacaccagtgttttttgttgttgctatttcttgtattactgcaaagcttaggaggttttctctcttaggtctaggggtcaagatcacgtttgcttgataagatgaaccaatgaacttccccgtcattttccgtgagcccaaagagtttatctttcatgacaccaactttctattgggctgagactgaataaaggactgaagtaggcactcacgaaatgtttgtcaaatactgatactgttgaaagagtagaattagttgcacctcaaaaatctgaaataa

SEQ ID NO: 109346 - DNA, 411 bp, Homo sapiens
tacaacacaattcaccagttccaagtatacagtttgataaattttgacaaatgcacatggtttgtaactaccaccaacatcaagatgtagaatatttccatgactccagaaagtttcttcaggctcctttacagtaaattctctctctaccatgaaagctgttgtttttgtggtctctaccatgatgacaaaaacaactgctttcattagtttttatgtatttgggaattttatatcaacagaattatataatataaagaagttttatatgtctggcttatttcattccgcataatacttttgagattcttctatattatggggagtagtaatttcttttttattgatgagtaatattctcttgtatgactatactacaatttgtttacccattcaccagtggatagacat

SEQ ID NO: 109347 - DNA, 628 bp, Homo sapiens
gcgactctggataatgagaatgtttaaaaagcagccacacagaatttatgcatataaatgcctactttaatctatttcatgtttataccttttgtattttaatatggttatatgccatttacgaaaataaatgattaattctttataataagaaaaataagccagggacagcagctcatgcctgtgctcccagagtgctgggaatacaggcatgagccaccacacccagtcagaaacttttttttttttttaagtattctctttggaagtcttgttgccccagcccaaggaatttgctaaattatccttataatcacaaacagtactctctctgagagggctcctgttgaactcagttttctctatcttcttatattttcagagatgtttcaagacccattttagactgatacctcattacatccccatctggctcactctttaatttggctctgggttccctataccaactgtttggggtttataataaagaatgtacatgttaattaaatatgttcatgccacttccagaagtctcaatcctggaaagaaaaaaaatgcaaaataagaaaaaacatctctatgctttaagacgttttttgcagtatcttgacggagagcagtgaga

SEQ ID NO: 109348 - DNA, 408 bp, Homo sapiens
atagagacagggtttcactctgttgcccaggctgatcttgaactcctgagctaaagggatcctcccatcttggcctcccagagtactgtgatcataggcatgagccaccacacctgacctgacacatttttttaatgtattatgaaaaaaatgtattttgtctctcattggttagaggagaaaaaatttcaaatagacataaaagtagagagaaatgtaacaaacccgtcttctacccatccttttgctcccatgtcatcagcttttcccccaggctttttttttgtgggggtggggtggaggtaaagttggcttatactgtattactagcaccgtaaattgctctagaaagtagttattacagattgttaaatgggaacgaatattagatcttgacatgggcacaaa

SEQ ID NO: 109349 - DNA, 1229 bp, Homo sapiens
gtaaacctgagactttcccagtctccaggagacaaaaccctaatttctttcaatctgctgtcttcctcgtgccgaattcggacgaggctataagcctgcattctataaatggcgtatgaccatgggctgtttccccccagcaagttgtacaaagttctgtggtaccagggaaagggcttaaggttagcagggcctctgcggaaggacatatgaagtgacttgggttaggaaacaggaagggataggattcaagaacagctattgcttctgttctatataggaaactgcagcgtgaaaaatgctgggctgggaattttgagacctgggttttagtttgtgttctaatactaacaagctatgtgactgtgggtaagtcatttcacattccatttggatgcctcttgagtgactccaggcctctccagctctaaaacattaagatcaggccctacgctacagctggccagtgtgtaattcttctgtttctatgctgttaggtcaaatagatcttcaatagttacttgattgttattacttttttctgaagtgggtgttttatcaatgttttaggatacagtgagtctgcttctcccctttggagttaggaaggttgtaggaatatacactgtagagcatatgggagctttatcccctccttttttccccgctacctttctccctctccttcccttcatcacatttctattgagcatatgccattgccgtgtaccaggtgtgtgctaggtttggagatacaaggtaaacctgagactttcccagtctccaggagacaaaaccctaatttctttcatctgctgtctttctctttggaaagaatcaacgatatcccaggggaatgtgcccatgtcccagggtaaccaactacagacagatgccccattctactcaagcaacttttagagtgccttgagatacacatcagataattatgcagggccaggcatggtgctgcacacttgtaatcacagcactttgggaggccgaggcagcagattgcttgagcccaggaattcaagtgtagcctagggaacatggcaaaaccccagctctacaaaaaaatacacaaattagctgcgtgtggtggcctatgacaggaggctgagatgggaggattgcttgagcctgtgaggtcgaggctgcagtgagccgagatcatgccattactccagcctgggtgacatagggagaccctgtcttgaaaaaaaaaa

SEQ ID NO: 109350 - DNA, 634 bp, Homo sapiens
ggcacgagggaaaggtagcggggaaaaaaggaggggataaagctcccatatgctctacagtgtatattcctacaacctttctccctctccttcccttcatcacatttctattgagcatatgccattgccgtgtaccaggtgtgtgctaggtttggagatacaaggtaaacctgagactttcccagtctccaggagacaaaaccctaatttctttcatctgctgtctttctctttggaaagaatcaacgatatcccaggggaatgtgcccatgtcccagggtaaccaactacagacagatgccccattctactcaagcaacttttagagtgccttgagatacacatcagataattatgcagggccaggcatggtgctgcacacttgtaatcacagcactttgggaggccgaggcagcagattgcttgagcccaggaattcaagtgtagcctagggaacatggcaaaaccccagctctacaaaaaaatacacaaattagctgcgtgtggtggcctatgacaggaggctgagatgggaggattgcttgagcctgtgaggtcgaggctgcagtgagccgagatcatgccattactccagcctgggtgacatagggagaccctgtcttgaaaaaaaaaa

SEQ ID NO: 109351 - DNA, 2372 bp, Homo sapiens
ctggcacgagggaagactgaagctttctgccgcgagtttcctccgagttcccgttgctgagacaaaggaaaacccactcccttggaggagcatgaccttttcctgtaattcttcccactgctgttgttgagctccttggatcctggctcctggacaccatcatcaagaagactttatggatgggctgtccacccactgagagaagaggagcatcagctacagtttctctctagattgccttcttcattttgagtaatgactgtcagcagggtcagattaaacacaaaacaactggacaattgcttggaggactaaactataagggcactaacatgtcaatagtaggctaacacatccatggaaaatatatttaccagctcttctctcagggaggattctgtgtggggttggaagtaatgatttgttaaattccttaggggtagaaagtagggcataatcagaatatagaggaatatgctgtttgacttcagggtttctgtttttcttactaggatatataaaacagggactctagctagattgtttatgaccacagagggtaggctgagtgctcccatgatcttcctgcttggttcttgcccatacagaggtcagcctttcctctaataaagattgaacaagtagtggtctgagggagacaccaattcattaccctacatgtctcttctctgcactccagggctttgataataaagacactggcagactatctatcttccatttctataatgtgagcccttagggagtcttcgttcacttgggggtgagggtcattgctcacagagtagttcaagtcaaatggaacttgaactctttgcctatgggcctggtggtcagactctgtgttgagttcattagattattggagacacaaggtagagctggatgcttcaaaaatatttggctaaaggatgacattgctggttatttgtagataaagccatgatggaacctgcttggaatcatgaaatatggaactggtggtcatgtttaaaaatacaactaatagttaagtacctactggacactgtagagacttaggggctagacagacatggttcctgcccccttggagcttacactgtagcttccccttaggtatgaagaacagtggctacaactaacaaatggccacaaagatataattgagccagtgttccaattattagggtaattcctatttccttaatcattcctattgaccatgttctataagcctgcattctataaatggcgtatgaccatgggctgtttccccccagcaagttgtacaaagttctgtggtaccagggaaagggcttaaggttagcagggcctctgcggaaggacatatgaagtgacttgggttaggaaacaggaagggataggattcaagaacagctattgcttctgttctatataggaaactgcagcgtgaaaaatgctgggctgggaattttgagacctgggttttagtttgtgttctaatactaacaagctatgtgactgtgggtaagtcatttcacattccatttggatgcctcttgagtgactccaggcctctccagctctaaaacattaagatcaggccctacgctacagctggccagtgtgtaattcttctgtttctatgctgttaggtcaaatagatcttcaatagttacttgattgttattacttttttctgaagtgggtgttttatcaatgttttaggatacagtgagtctgcttctcccctttggagttaggaaggttgtaggaatatacactgtagagcatatgggagctttatcccctccttttttccccgctacctttctccctctccttcccttcatcacatttctattgagcatatgccattgccgtgtaccaggtgtgtgctaggtttggagatacaaggtaaacctgagactttcccagtctccaggagacaaaaccctaatttctttcatctgctgtctttctctttggaaagaatcaacgatatcccaggggaatgtgcccatgtcccagggtaaccaactacagacagatgccccattctactcaagcaacttttagagtgccttgagatacacatcagataattatgcagggccaggcatggtgctgcacacttgtaatcacagcactttgggaggccgaggcagcagattgcttgagcccaggaattcaagtgtagcctagggaacatggcaaaaccccagctctacaaaaaaatacacaaattagctgcgtgtggtggcctatgacaggaggctgagatgggaggattgcttgagcctgtgaggtcgaggctgcagtgagccgagatcatgccattactccagcctgggtgacatagggagaccctgtcttgaaaaaaaaaa

SEQ ID NO: 109352 - DNA, 2417 bp, Homo sapiens
gagcttctgccctgagactcagaaaaatattctcctgtgctttggttcagtatagatttctaaaccctgatcattgcttaagagatattcactgagggttgctgagacaaaggaaaacccactcccttggaggagcatgaccttttcctgtaattcttcccactgctgttgttgagctccttggatcctggctcctggacaccatcatcaagaagactttatggatgggctgtccacccactgagagaagaggagcatcagctacagtttctctctagattgccttcttcattttgagtaatgactgtcagcagggtcagattaaacacaaaacaactggacaattgcttggaggactaaactataagggcactaacatgtcaatagtaggctaacacatccatggaaaatatatttaccagctcttctctcagggaggattctgtgtggggttggaagtaatgatttgttaaattccttaggggtagaaagtagggcataatcagaatatagaggaatatgctgtttgacttcagggtttctgtttttcttactaggatatataaaacagggactctagctagattgtttatgaccacagagggtaggctgagtgctcccatgatcttcctgcttggttcttgcccatacagaggtcagcctttcctctaataaagattgaacaagtagtggtctgagggagacaccaattcattaccctacatgtctcttctctgcactccagggctttgataataaagacactggcagactatctatcttccatttctataatgtgagcccttagggagtcttcgttcacttgggggtgagggtcattgctcacagagtagttcaagtcaaatggaacttgaactctttgcctatgggcctggtggtcagactctgtgttgagttcattagattattggagacacaaggtagagctggatgcttcaaaaatatttggctaaaggatgacattgctggttatttgtagataaagccatgatggaacctgcttggaatcatgaaatatggaactggtggtcatgtttaaaaatacaactaatagttaagtacctactggacactgtagagacttaggggctagacagacatggttcctgcccccttggagcttacactgtagcttccccttaggtatgaagaacagtggctacaactaacaaatggccacaaagatataattgagccagtgttccaattattagggtaattcctatttccttaatcattcctattgaccatgttctataagcctgcattctataaatggcgtatgaccatgggctgtttccccccagcaagttgtacaaagttctgtggtaccagggaaagggcttaaggttagcagggcctctgcggaaggacatatgaagtgacttgggttaggaaacaggaagggataggattcaagaacagctattgcttctgttctatataggaaactgcagcgtgaaaaatgctgggctgggaattttgagacctgggttttagtttgtgttctaatactaacaagctatgtgactgtgggtaagtcatttcacattccatttggatgcctcttgagtgactccaggcctctccagctctaaaacattaagatcaggccctacgctacagctggccagtgtgtaattcttctgtttctatgctgttaggtcaaatagatcttcaatagttacttgattgttattacttttttctgaagtgggtgttttatcaatgttttaggatacagtgagtctgcttctcccctttggagttaggaaggttgtaggaatatacactgtagagcatatgggagctttatcccctccttttttccccgctacctttctccctctccttcccttcatcacatttctattgagcatatgccattgccgtgtaccaggtgtgtgctaggtttggagatacaaggtaaacctgagactttcccagtctccaggagacaaaaccctaatttctttcatctgctgtctttctctttggaaagaatcaacgatatcccaggggaatgtgcccatgtcccagggtaaccaactacagacagatgccccattctactcaagcaacttttagagtgccttgagatacacatcagataattatgcagggccaggcatggtgctgcacacttgtaatcacagcactttgggaggccgaggcagcagattgcttgagcccaggaattcaagtgtagcctagggaacatggcaaaaccccagctctacaaaaaaatacacaaattagctgcgtgtggtggcctatgacaggaggctgagatgggaggattgcttgagcctgtgaggtcgaggctgcagtgagccgagatcatgccattactccagcctgggtgacatagggagaccctgtcttgaaaaaaaaaa

SEQ ID NO: 109353 - DNA, 2540 bp, Homo sapiens
gagcttctgccctgagactcagaaaaatattctcctgtgctttggttcagtatagatttctaaaccctgatcattgcttaagagatattcactgagggtcctacgtctctgcaatttgtgtatgaataacagaataatttccctcttttgtttcgcctttcctgttcctgaatctaaataaagatggctttttagtattaaaagtggaagaaaattacaggttgctgagacaaaggaaaacccactcccttggaggagcatgaccttttcctgtaattcttcccactgctgttgttgagctccttggatcctggctcctggacaccatcatcaagaagactttatggatgggctgtccacccactgagagaagaggagcatcagctacagtttctctctagattgccttcttcattttgagtaatgactgtcagcagggtcagattaaacacaaaacaactggacaattgcttggaggactaaactataagggcactaacatgtcaatagtaggctaacacatccatggaaaatatatttaccagctcttctctcagggaggattctgtgtggggttggaagtaatgatttgttaaattccttaggggtagaaagtagggcataatcagaatatagaggaatatgctgtttgacttcagggtttctgtttttcttactaggatatataaaacagggactctagctagattgtttatgaccacagagggtaggctgagtgctcccatgatcttcctgcttggttcttgcccatacagaggtcagcctttcctctaataaagattgaacaagtagtggtctgagggagacaccaattcattaccctacatgtctcttctctgcactccagggctttgataataaagacactggcagactatctatcttccatttctataatgtgagcccttagggagtcttcgttcacttgggggtgagggtcattgctcacagagtagttcaagtcaaatggaacttgaactctttgcctatgggcctggtggtcagactctgtgttgagttcattagattattggagacacaaggtagagctggatgcttcaaaaatatttggctaaaggatgacattgctggttatttgtagataaagccatgatggaacctgcttggaatcatgaaatatggaactggtggtcatgtttaaaaatacaactaatagttaagtacctactggacactgtagagacttaggggctagacagacatggttcctgcccccttggagcttacactgtagcttccccttaggtatgaagaacagtggctacaactaacaaatggccacaaagatataattgagccagtgttccaattattagggtaattcctatttccttaatcattcctattgaccatgttctataagcctgcattctataaatggcgtatgaccatgggctgtttccccccagcaagttgtacaaagttctgtggtaccagggaaagggcttaaggttagcagggcctctgcggaaggacatatgaagtgacttgggttaggaaacaggaagggataggattcaagaacagctattgcttctgttctatataggaaactgcagcgtgaaaaatgctgggctgggaattttgagacctgggttttagtttgtgttctaatactaacaagctatgtgactgtgggtaagtcatttcacattccatttggatgcctcttgagtgactccaggcctctccagctctaaaacattaagatcaggccctacgctacagctggccagtgtgtaattcttctgtttctatgctgttaggtcaaatagatcttcaatagttacttgattgttattacttttttctgaagtgggtgttttatcaatgttttaggatacagtgagtctgcttctcccctttggagttaggaaggttgtaggaatatacactgtagagcatatgggagctttatcccctccttttttccccgctacctttctccctctccttcccttcatcacatttctattgagcatatgccattgccgtgtaccaggtgtgtgctaggtttggagatacaaggtaaacctgagactttcccagtctccaggagacaaaaccctaatttctttcatctgctgtctttctctttggaaagaatcaacgatatcccaggggaatgtgcccatgtcccagggtaaccaactacagacagatgccccattctactcaagcaacttttagagtgccttgagatacacatcagataattatgcagggccaggcatggtgctgcacacttgtaatcacagcactttgggaggccgaggcagcagattgcttgagcccaggaattcaagtgtagcctagggaacatggcaaaaccccagctctacaaaaaaatacacaaattagctgcgtgtggtggcctatgacaggaggctgagatgggaggattgcttgagcctgtgaggtcgaggctgcagtgagccgagatcatgccattactccagcctgggtgacatagggagaccctgtcttgaaaaaaaaaa

SEQ ID NO: 109354 - DNA, 1316 bp, Homo sapiens
  misc_feature (1135)..(1135): n is a, c, g, or t
  misc_feature (1138)..(1140): n is a, c, g, or t
  misc_feature (1153)..(1153): n is a, c, g, or t
  misc_feature (1157)..(1157): n is a, c, g, or t
  misc_feature (1163)..(1163): n is a, c, g, or t
ctggcacgagggaagactgaagctttctgccgcgagtttcctccgagttcccgttgctgagacaaaggaaaacccactcccttggaggagcatgaccttttcctgtaattcttcccactgctgttgttgagctccttggatcctggctcctggacaccatcatcaagaagactttatggatgggctgtccacccactgagagaagaggagcatcagctacagtttctctctagattgccttcttcattttgagtaatgactgtcagcagggtcagattaaacacaaaacaactggacaattgcttggaggactaaactataagggcactaacatgtcaatagtaggctaacacatccatggaaaatatatttaccagctcttctctcagggaggattctgtgtggggttggaagtaatgatttgttaaattccttaggggtagaaagtagggcataatcagaatatagaggaatatgctgtttgacttcagggtttctgtttttcttactaggatatataaaacagggactctagctagattgtttatgaccacagagggtaggctgagtgctcccatgatcttcctgcttggttcttgcccatacagaggtcagcctttcctctaataaagattgaacaagtagtggtctgagggagacaccaattcattaccctacatgtctcttctctgcactccagggctttgataataaagacactggcagactatctatcttccatttctataatgtgagcccttagggagtcttcgttcacttgggggtgagggtcattgctcacagagtagttcaagtcaaatggaacttgaactctttgcctatgggcctggtggtcagactctgtgttgagttcattagattattggagacacaaggtagagctggatgcttcaaaaatatttggctaaaggatgacattgctggttatttgtagataaagccatgatggaacctgcttggaatcatgaaatatggaactggtggtcatgtttaaaaatacaactaatagttaagtacctactggacactgtagagacttaggggctagacagacatggttcctgcccccttggagcttacactgtagcttccccttaggtatgaagaacaggtncannnacaatggccaatntttnggccgntcctttaggaacgcaactaaatcattggaagtgtaaagcggttaagggggacggggtcccccagtgaattgtgccaggagagcctgatacatggaagagggactctgcttaaaggagagatggaaagtcgttgcgtaacatattgttttttgt

SEQ ID NO: 109355 - DNA, 271 bp, Homo sapiens
gggaggtggaggttgcagtaagctgagattgcatcactgcactccagcctgggcaacggagcaagactccatctcaaaaaataaataaataaggaagaaagtaagaaagattttggtggtgcttacctgctgagatgaacattactgtctctactaaataacctcataaaatgttttaaatgcattctttatttagggcttcagaccaatgtatctcctactgttcctctctcccttcttctatgtctccacccctattccctaccctttc

SEQ ID NO: 109356 - DNA, 623 bp, Homo sapiens
gaccagcctggccaacacagtgaaaccctgtctctactaaaaatacaaaaattagctgcgtgtggtggcacgtgcctgtagtaccagctacttgggaggctgaggtaggagaatcgtttgaacccaggaggcagaggttacagtgagttgagaccatgtcattgcactccagcctggacgatagagactccatttcaaaaaataaattaattaataaatttcaatttctactgaattttattacaatgacttcatatacatagtaaatactggttataagtaatccttcccaagaaggacctgcaataatgctgttcaagttgccactgagcttactctcctcgccaaaaggataccgtggaagtcactgtcttcgcagatttccaattctcaaacatcaaaatctctctagtcacttatttgggattttcagagacttacatttcttatagattatggtagaaaaggcttatgttgtagccaggcgtggtgggtcaccctgtaatcccagcactttgggaggccgaggcaggcggatcatgaagtcaggagttcgagaccagtctgaccaacgtggtgaaaccccgtctctactaaaaatacaaaaattagctgggcgtgat

SEQ ID NO: 109357 - DNA, 454 bp, Homo sapiens
tattctatttctgtacaatattctttcccactcagaagaactattcctctgtgattactgctagtctctaactcatttcttaatactaactaaatacacattcacaatgaattagcctatatcatgttctattttgatctttgatgttgctgtcaggcagaataacagtatgaaattataacagttgtatttaatgtaacctgtgtggtacttggcaacatcatgaatattcattctttggtaagacttagcctttggctttgttcctgattcagattttcctcacatgtggctatgtggtagctcttgctcaactatctagatgcttgctggctaatgcttttcacttgtcaaatggtaaatatgcagccatcactttccagataatattgccatctgggtagaaatcaccgtacattctgaatttttcttgtgtactttttagctctgtgaa

SEQ ID NO: 109358 - DNA, 278 bp, Homo sapiens
acactaccctacttcaagacttactataaaactgcaataactgagacaatgtggtgttggcaaatagagaaacaggtcagtgaaacaggataaagatcttagaaatatactgacaaaaatgaaatcaactgatctttggtgaagaagcaaaggcaatacaataaagcaaaggtagtcttttcatgtttgaacaactggacattcacatacaaaaatgattctagatatagactttatacccttcacaaaagttaacttaaaatgcatcacacacctaa

SEQ ID NO: 109359 - DNA, 670 bp, Homo sapiens
gacagtggaggaatcagagaaagcgtgatgatgaataagtccctgaatcatttcttttctctctgctggttgaactctctcctcccaaaaagtgactgtggccttccagatattgtttctctccatttggctacttgggtctgcccttttagatgtatctagatttttgggtaattcatttagtgttataagccatttatacataaatcttgacatttggaactgctttgtcacctgtgtttctagttacacactggtataatccaggatttatccagaaaattctttcctttacccttccctaaggctaaagctgagtttttgtcttctcttccttgaatggaaggaatacttacattttttccccaggtttgcttttgaggccctttgctattttcttttaggtggtgattgaactctgtatacgaagtcctccagggagttggcctttgccatgcagtccttcttgcatacacagtccctgaagtactcaggtgctgctcaggtctcagagttcttggatgatggtacttatgagctctctatgtcgtattgcctactctatgaaccttgggagattactcttcctttttttttttttttaagttagatttaaaggagtgttttacctgaaggctcatttaaggttatttttcaaactacaaactgg

SEQ ID NO: 109360 - DNA, 528 bp, Homo sapiens
tctgaagagtcttcttctagcatgactctattctactcaaaaatctctttttatctttctcttctcttcttttttcactttttctgaggaacgagttgtcttctgctatatcaagcgaagctccccatttgtgtttttgattataaattctccaaattttctagaatcttgctccatgatcccccacctaacccaatccagccctctattaccataagatacttatttacttccccggcatggtggattatccctgtaatctcagcaccttgggaggccgaggcaggcagatcacttgaggttagttcgaaaccagcctgggcaacagggcgaaattccatctctacaaataataataatataaaaattagcctggtgtggtggtgcatgcctatagtctcagctacttgagaggctgaggtggaggattgctggagccagggtggcggagattgcagtgagcctgcatcgcacgactacactccagcctgggtgacagagggagaccctgtctcaaaaaaaaaaaga

SEQ ID NO: 109361 - DNA, 780 bp, Homo sapiens
ctctagtacaaccgacaaaatagttcataaagagatttctattactatgaccattttactgataaggaaattgaggcttaggcaggataagtgacttgaacaaggtcacatagctagaaagcggtggaactgggaatgaactcaggtaattcaccttcagagcttgcatgcctttgccaagtcaagcacttttaaagacctactttctaaagtgatcaagaagtttaaaagcctggacagggaaaagtaaagggaaaaaaagtacacaattcttagactttaaaacaacagcaacaaaaactactgtcagtctagaacctcttaaagcttcctggtttccaaagatttagaaagaaaaaccaagggggcgtcaaatttaaaacagtaaacatagagcctgaaaataatagagatatatatttaaccttcacacaaaccctatgatgtaaatgctttcaggaaacaaagcttggagtggttaagtaatgtggctactacatacaccaacaatgtataaaaactataaatttaaccttggtctgtccagctccaaagctcatgtactttttttctgctacttcattaagtgctgtgaaattctgcattgataactgtagaggagagaattggtgttcctgaaagaagagctcaccattgcagtgtgctaactctgcttttgtttaagaagagaaagtaaatgttatgtagtgcacttgttttgtctatttatatagacattttaatttttattttctttctaaatcctagatatggaaaaaa

SEQ ID NO: 109362 - DNA, 233 bp, Homo sapiens
tcttatatgcggaaaacccccgcgggattttacatcgcagaaagccactatatgccttagtccttcaggccataagctctgagggcataactgagtcagtcatcattgtcctgtgtcctggcacccggtaaagtgcctggcacatagtaatcgctcagtaaatgttggctcctgtcctcaattactgaacatttactatttctgtcctcaattactgaacacttactacaagc

SEQ ID NO: 109363 - DNA, 336 bp, Homo sapiens
ctgagaggttatgtcctgaaaggcaggcctaagtgctgggccaggaactttataggccacatcaaagttgacccccagccactggcaccttttgaagaagcagcattcgtgcatagaggcacaacttcagatcagtctaaaagcctgaaaatatacagaaactacattcattgggcagtctggtattcaaccgatttcttccataattgaatgaaggcataataacactgatgggtttcccatcctctaaaccagataaaaacacagtaacatagttgttgacctgtatgaagtcaggatccatgtcctttatagaacctatggggcattttctca

SEQ ID NO: 109364 - DNA, 130 bp, Homo sapiens
tggaagaggatgtcaatgggcaggaatggagccaaactctacgggagaacggagctggccaggcagagctgctggacacctgaggctccctccttccaccacaaacaccactgccccatggcctagagag

SEQ ID NO: 109365 - DNA, 312 bp, Homo sapiens
gcagtgacacgatctaagctcatggcaacctccgcctcccaggctcaagcggttctcgtgcttcagcctcctgggtagctgggattacaggtgcgcacaaccatgcccggcttgtatttttagtagagatgggatttcgccatgtgggccaggctggtcttgaactcctggcctcaagtgatccacccacctcggccacccaaagtgctggaattacaggcgtgtgccaccacgcgcccagccctgatacttgttttttacatatttacttcatgttctttgaaggcaggcactcgccaaggcttaacactt

SEQ ID NO: 109366 - DNA, 625 bp, Homo sapiens
aaataaaatggtttattcatatactgaaataaagtagcggaaatcagctaattatatatatatatataaatatagatgatattctagaaacaatgttgagtggggggaaaagaaaaattagagttgaataccactgtaataaaattttgtgtacatatataaatctgtagaaaaaaattaacgatttcaaagttttcaggatagaaggtacttctgagaaggaataggatcaagggagaagaacatggtggggttgggggacttaaactgtcctcaaactgttcagtgtcttacatttggtgccagatttccaagttcataatgcttcattacattactttctgtacataatatatttcctgataacattttctaacgttcggccaaaaccacattaatacaaagttattagtacaaagaaaacaggtggtttctttgaaactttactttgaaggcaaattggataaagagtcaagacccatcagtgtgttgtattcaggaaacccacctcacatgcagagacacacataggctcaaaataaaaggatggaggaagatctactaagcaaatggaaaacaaaaaaaggcaggggttgcaatcctagtctctgattaaacagacttt

SEQ ID NO: 109367 - DNA, 318 bp, Homo sapiens
gggatgtgcaggtgaacatcagaccaggatgggaaccttataatatctatgatatactatggcttctatcaaccagtttcaggaaaagcaaagaagaatgcagtcatggccaggtgcagtggctcacacctgtaatcttgaggtgggcagatcacatgaggccaggagttcgagaccagtctggccaacgtggtgaaaccccatcgctactaaaccccgtctctactaaaaaataaaaaattagccaggcatggtggtgggtgcctgaattcccagctacttgggaggctgaggcaggataatcacttgaacccagga

SEQ ID NO: 109368 - DNA, 307 bp, Homo sapiens
tcttcacggctgcaactcccatcacagtcctaaaggcctagaagggaaaaattttttcttgggttgggcccaggtcctcggtcctctgtgcagccttgggacgtgaagacctgtgtcccagcagctccagctccagccatggctcatgccactgcttcagagggtgcaagccccaagccttggcaacttccacatactgctgggcctgcaggtgtgcagaagacaagaattgaggtttaggaacctccacctagatttcagataatatatggaagtgcctggatatccaggcagaagtgtgctgcag

SEQ ID NO: 109369 - DNA, 462 bp, Homo sapiens
tgtttgcactgaatttaaaacagaacaaaggtaggaactacactttttgggtggctgcgccttgcaaatgtattcggatgcaggtttgtgagcagcgccatggccgacagaaccacaggcaggcggcaggtctcctgcagcctcccccacggtgcaggggcgcctttccggctcctctaagaagcgctgctgaagccacgccctggcttagcgcggaggaggagccaccgtggggcaccgtggggagcgaggcctgagccccgcctccccagtcaccgagcacttcctgtccctgctcagtaatcaagcacagacttcagatcttggcatctcagtctgaactccttaaaagccaggtattttaaaagaaacgttttaaggcaaattggtacctatttccagcccacctttctgtagtgcaagaactgtctccaaacctcctaaataaatcttccagacaaa

SEQ ID NO: 109370 - DNA, 181 bp, Homo sapiens
ttatcaatgctaatttagtgctgaaaacgactacgatgtaaaacttctgcaattccgtggctgactgagtttgactggccggttcttctgctccacatggtgcagctgaggttgctcacacacttgggagcttagctgagagcaacactgaggctgaaacgtccaggttagcctctcaccc

SEQ ID NO: 109371 - DNA, 230 bp, Homo sapiens
gtccaggctctctacctgtgcagtcatgtccagcattatctttttatgtccacagtatgtgagtttcgtcagtgaagaaactcatctgagtctttgattttccagttttactggggctcaaaatcacatactagctgaaaggtgtagcttcggcctctgggaggtcagactaataactttagttcccacttcttctggaggtcagaattgatactggaatgtcgaaagcc

SEQ ID NO: 109372 - DNA, 333 bp, Homo sapiens
atgggctctcagcctcccctctcttctccctttcacttcctcactacctgctctcttctcccgttttccatgcaccttcttccaaatttctcctccctctcctcctcattcctcatgcaaagcaaatgctcagctgccttcgctggcctggttatgtcccaggatgcaagttattttacaaaactgaaattcatcagcatttttagtccttctactttgttctatctctagtgggttatttaattttgggaacccaatatcatatctaatgttcattagctttttaatgaagcagtggatcctagagcatcaaatagatgtgttttgatagcc

SEQ ID NO: 109373 - DNA, 211 bp, Homo sapiens
ctattataggacccagagtttgaagacctaagaaccaggagaactctgatgtcgaagaagaaaagaaggatgctcagctcaaggaaagagagagaatttgcactctctctgcctttctgatctattcagaccctcaatggattagataatgtccatctacattgctgagggcaaagttctttacctagtgtactgattcaaatgctaatct

SEQ ID NO: 109374 - DNA, 528 bp, Homo sapiens
agcccatgcggcatctttcacaggttgaactcaggtgtctgcaactcacccaggccagtgttacactctggtggctctacagatctggggtcttcaggggcagtcctacccccacaatttcactaggctttgccattgtaggagctattggtgttggccttgaccccatcacttctctggacattgccctggtgatggtgacaggaggcagtcaaatgcctaggcagataaaggtgggtccctggtgaaaccttgcctccaagccaaagatagtttaaagccgaaaagccaagctacaacttaaatccttgaaccacattgagaatctgtcttcccatatggtgcactttcctctgattgatccccacccttcgcctattttacatatacctactgtttcctaattggttttctacactgtcatgcccacctttgagtggtaactttgctttaatcttttttgcatcctcacaaaaacaatcagcacgcactccccattctgaatccataaaaagacctggacccagc

SEQ ID NO: 109375 - DNA, 311 bp, Homo sapiens
aagcgagcaggataccagcactgctcaataaaaacatgagccacccaggtataaaatttttcagtagccacattttgacaaacaaaaacaggctaattttgggccgggtgcggtggctcacgcctgtaatcccagcactttggggggctgaggcgggcggatcagggtcaggagttcgagaccagcctgaccaacctagtgaaaccctatctctattaaagatgcaaaaattagccggctgtggtggcgggtgcctgtaatcccagctactcaggaggctgaggcaggagaattgcttgagcccgggaggt

SEQ ID NO: 109376 - DNA, 737 bp, Homo sapiens
cgtggcaggttctgaggggctactgtgtgcctccttgtgaaagcggcaaggttgggctggccgggcaggcacacagttctggttcacgcgggtgcccacctggcagtggctgagtggcccagagcctgggtgcccaaagttccctcagcccaggtgtgcccgtcactggtgctgccctccctgttgccgcctggagccctccggcccactggggagggcagcttctcctgatctttccaccgtgtcaggagcagctggcctgaaagggcagaagtcagtgtccagggcccacagaaactatgtgctgggcaggagactctcctgatcttttgagagctgtgggtacgggctctgagctggcagtgatatcaggggacccagaaccccgctgtgggtagagtaagggctcccggagacctggaggcaagcccgccctgcagtgaccctgggaccctcagcctctcgtgcctaagggaaggggctgcctgtactctgcagttggcagagcctgcccattggttccttgacctaatgattatgagccattttggcaggaaaaaaacccaaacgaacaagtggaagcttctaagaccctggccaagagagtcattccacacatcctgagcatctgcagaaattaggaccatccccaaagactcaaaagatacagggatggtcagtcccactgtccccactgttcccactctgttcacccatatggtccacaaaaaccagca

SEQ ID NO: 109377 - DNA, 385 bp, Homo sapiens
aaaacaaagaaaaagattcaacagagtttatctgagcaaagaatgattcatgaatggtgtagcagtcagaatcaggggaggttcagagagctctgctgcagcagcctgagcagtgagtttttatgggctgacagagaaggaagacaaaatatatttaactggttagagtggaaataccctagttagaggtgagttgctgatttctgattgataaagtctccagtctccttttactgtttacactgggcttcagtttgcttatgtaggaacttaaagggcttgagcggtccaagtcgggtatccagtggcttcccctacccttttttttttttttgaaatggagtctcactctgttgcccggacttgagtccagtggcccgatctc

SEQ ID NO: 109378 - DNA, 314 bp, Homo sapiens
tctttcttccagactgcccacctcagccttaggaaaggcctaagggcccaaggcctcaaggccctgggaaatctacttctctgggattgacttctctttgtctagttctctcacatgaagcctcaccggggcacttctctccactttaaccaccaaagtatactcctcagctgttcccattgctctttggatcagaaccaagattcttaacttctttttgtaacctgtaagggcatcattcagctctcacctttcagagattgccctgcttcccatctggttccgtgtgtgtgtgtgtgtgtgtgtgtgtgtgt

SEQ ID NO: 109379 - DNA, 423 bp, Homo sapiens
catacatgcattccttggaaagctgaacaaaatgagtgggaactctgtactatcatcttagttgaactgaggtccaccgggggctatagagggacaactgtcattttttttgatgcccgttgcatgaagcattcttccaggcttaggaagggattccgtttgggtgaaggagagtcacaggggagttgaggctatgtgcacaggacttctgtctacaaggctggggtagcacacatgcagtccgtgggactaggtgaatgtgcaggttgctcagggagagttaacctgtagcctgcctctgggtggccaagattgtccttgactcctggctctgggttcccacaacccctggaggaagacaagtaattgtgcttgggaagagagaacaaggccatacttttgcctttctttttttcattctta

SEQ ID NO: 109380 - DNA, 348 bp, Homo sapiens
tagtagagacggggtttcactgtgttagccaagatggtctcaatctcctgacctcgtgatccgcccgcctcggcctcccaaagtgctgggattacaggcctgagccactgcacccggccagcaatatttcttctgtaaaagaaaagaataagtgttccacatggaaagaacccaagatatattaagtgaaaaatgtcatagcatgactacatttctgttaaaaaaaaaaaacaaaatgttatatatatatgcgaatgcagagaaaaaagaaatgtaaaaaatacaataaatttttcacggtgattacatttgcgagaggaacgtacagctttcatatttcattcaatg

SEQ ID NO: 109381 - DNA, 340 bp, Homo sapiens
agggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtcatggagacatcctcaaaaggtctgcttacccaagttactcagttttggaacctcctagatgatctagctcagagtgaccctgagggctatgagaagtttattcagcagcagctgaaagaagggaaacagctctgtgctgccccagaaccacagctttgtctacagaccaggattctgg

SEQ ID NO: 109382 - DNA, 275 bp, Homo sapiens
cacacacacacacacacacacacctgcatacttgaacgataaatttttataaatgaaacttcaatgttaaaggataaattgtaatagaaactggtaacatgtcatttaaaagatggtaactataccctcatcaagagtatatatatgaggccaggcacagtggctcatacctgcaatcccagcactttgggaggtggaggagggaggatcacttgagcccagtagtttaagaacggcctgggcaacatagtaagaccccatctctattttacact

SEQ ID NO: 109383 - DNA, 219 bp, Homo sapiens
gtggttggggtaaacaccagaatgaatagctagaagagatgaaaatggttgatgtaggtggcctgccatggctaggatattgcttttttttacatattcttgtatgtatgtgtgtatactgttttgattaaaaataacaattgatttaaaaagggaagtagaaaatgtagatgatcaaaatgaaataaataagaattgcctagtattacacccccaaat

SEQ ID NO: 109384 - DNA, 406 bp, Homo sapiens
agtcaaagtgtaggagttgctaattgtgtgaagtgtcaaggaaagcaccccggactgggcttgtgggttgaatttgcagctgttctgctcaacaagctgtatatgaccctgaacaagtccttcacttgaagcgatctctttttttaagaaatgggatcttgctaggttgtccaggctagtctctgaactcctgggctcaagtgccttggcctcccaaagcactgggattacaggtgtgagccactacgcttggcctgatctctttttttcattgataaattgaggcaactggactggataattattctagagtatttacagctataaaatgtatagattttgtaaaccatgcacagaattgaaatgctgttaacgtatccttttgttgtcatggcagctatggata

SEQ ID NO: 109385 - DNA, 259 bp, Homo sapiens
tctaaaagggctctagactagaggaaaaataaggagagcctgagaaacacaacacgaatgggaccctggagggtcacagtcacagtcgttccatagtcaggacagaactcactcctgcagtggctggagtcagtcaccagcatcctcacacttttgtggacaaattttggctcaaccaaagattctgacaaagcatcagacttgctggctagtctcgtgatcattatcaagtgtattatttgtcttggagacctcttca

SEQ ID NO: 109386 - DNA, 483 bp, Homo sapiens
aaataaaaggggtacggaaggattttacagattcaaatgtagtttaagagatatataagccagttgcaatgtataggccttaactgtactcagaatcaaacaaaatcaaacttttccacaaacagaaaacatgttggagagtatggacactgactgtatatttgatgttattaaataattgtgcatgcacaggaatcagttgggaaacccggggaacagatgctgctgacctgacagtggggtttcaagaagaatatgtatttgagaaatacctggacataccactgaaggacttggttactggtcagatgttgggaccagagcaggggaggagtcagacgtatgtcttgagagacactgggtgggtggaagaagaaatgataaatgagtttagtttagaagtgcatattaggtcatcaagtggagatcctaagttagaagatgaatattgagtttgggctcaggagaagaggattgggctag

SEQ ID NO: 109387 - DNA, 261 bp, Homo sapiens
gctgctgttttttaatgctctcccaatggttctgatgattagccagattctagaatcgctggactagtatgttactatacaaccatgctttccagcgtctacctagagcaaattaccctagagctccaagagttttagctcttagataagcactaactgtccactgttacagcacatatacactgcaaaggccattctgatggtcctcaagtatgctctgttctctccatgttccaacttttgcctcccacttcccatttc

SEQ ID NO: 109388 - DNA, 191 bp, Homo sapiens
attgtatcatttttttccttcactctcaaagtggagatgtgtattcgtaataccaaaatgatgcatttaaaatggtcattgatgagtttttaagtgcagagtcacaacagatttctagaagcaatctttcagactgctttcagtattgagtccaggcaacaaatacaatttgcacaagatctcacagctac

SEQ ID NO: 109389 - DNA, 453 bp, Homo sapiens
aggcactatcctgggtgcttttcatcagttcgtttaatccacatagcagtcatatgatatgtgggtactttaatcatccccactgtacataggctacaattgaggcttagagagattacttaacttactcaaggtcacatagttcctaagcggccagaacttgaacctaagactgtgttgttgccaaagtgcattccccaaacctctgccctctaaagcgttggataggagacagagtcaccggaagggaaggtttgcatgagagaggaaagcaaccatgtgcaagtagccagtggtcaacttggagaatgctgacctcccttccatcccaggtgaataagtgagtaggatgtggggattctcagtctcactggagatggctataaggaaatagaatctttaggggagagccaggtaaatgttagaaacaaattcgagtggtgcattgtgtga

SEQ ID NO: 109390 - DNA, 283 bp, Homo sapiens
ctgttggtgtgagaaggggctgtaaagaggcagggcagggggctgccagattggagatgtaggtaccagagcttggtgtagctcagtctccagggagacactgggtgatgaggctggggtgtcagtttccacagcagcaatcagtgtgcaggtctgttgccagggagacaggcctttcagaaagtgttccactcacaccccttactgtcatatctcagcaccatttgaggataacgtagcttcaagttttacgaagagtcacttggtgtagtggccatggtta

SEQ ID NO: 109391 - DNA, 398 bp, Homo sapiens
ccattcgagctcggcacccagcaatctaattattgtgaactgccaacaattttaatcatttgggcagaagctttcagtaattcaaaagaatcctccattgatacactattttggaaatgatcttttttcttggctctcaaagtcacgagaaactataattaaatgtcagaaggcatctgacatgcgaagaaggtgaagtgagagttgagcatgagtcaagtataaaagtagagcctcaggcacaaagtagttatttttaaaagaggaatgcataaataatcaaagtacatgcctaatattactatttgtccaaagcttgatttttgaaattctgcatttttaatggctctctaatacattttacaaagctaaagcaaaagacaagataaaagaaagat

SEQ ID NO: 109392 - DNA, 392 bp, Homo sapiens
tggatgccttttatgttttagtttcttacaaagcaatttccagcactcagataaaccatttgagaggaacagacttagaattccatattcacagaactgtgggatttttaaaccacaaaggaaacctagagatcctagaagactgttctgtggatgtggaaagttcaaatatcccccaagactgcacagctaattagaggcagagctggggtaaggactcaggtttcctggctctcaactcaaatctctttccaatatcatttctcaaattctaagatcagaagttgaatgaaacgattcgcttcacatttcttgtggtttgaaacatgagcttctcagaatctccagcttcagtggggtcagggtaacgtattggctgctactgatggagg

SEQ ID NO: 109393 - DNA, 369 bp, Homo sapiens
aagaccctatgggctgcaaggatgaaaatgagtcacgtgaaggtctggggtggggaaagcatcccagtgccaaaggtagagattggtaaggacccagaatgctatgggaggaggggaaactaatggaaggagaggggtggtgcaggaaaacaactgtgggttttgggtaaggcttctaagcttgagttgtctccctggaaagatgacaagaatgaatgtaaccagtcacattgaagcttgtcaaaggatcacatatatatgtattctgctttatgtctagtgcttgcaactgcagttttgtttaaggtaatgttttaatgtcttgagtcttggtgacaccagagatgtgatggcccagaagaattttta

SEQ ID NO: 109394 - DNA, 705 bp, Homo sapiens
gaagatcctggttcccacccttgctttctcatcccccaggacactgaaagggagcagatatcaagagaagttcaccatgttgtttaaagtcactggtgtcccctgaaaaccccaagtcagggcagtcctgaagccagaccatcctgccccaccaaagagccacttgtgccagcagagaggctgcaaaatacccatcctcagtgtccaagaggcaccaagaaagtacagatacatgccaccccctttccagagtctaaactcagcacctatggctcgccagaggggctgacagagagcgcctcccaggccctgcagctccgaagcccaggctgcgtcctggacctgtctcttaagccagggctgccccacgtgcagtccaacacgctcatgctgctgctgctgccactgtatctatccatccatccatcaccgccggtggatggcgcctggggcacttttcactctgtggttttaagcatttactgtttcttttgaaatgttccaagtaggtgcctgaaatacccatatttgcttctttttaaaaaactcacagaaagattctttttgctctccatcccctccctttgctcttccccctccctcggcatttttaatctgtgggttttccctggttttggaaattccaaaagtgggggtcaggccccctttctcaccataacagatttgcgggtgtgcctggagacc

SEQ ID NO: 109395 - DNA, 256 bp, Homo sapiens
atacatcattttttttcccagctgtatagtattcagttggattgaggcatcataatttattttgacaaggtcccctctggttggacggactctttggttttcagttttttattaatgtgaagggtgccgtagtaagtatccttgtacatacatctctgcatcatttcttatgtaatgtttgagagtccaggaatgctgctcgcccatcaaacctgatccccctgcccccagccccttgccattgccaccctttgcc

SEQ ID NO: 109396 - DNA, 505 bp, Homo sapiens
tgaggacctgccatactgtttcccaaaatgtactaatgtacaatattaccaacggtctccaagggttcccttttctccacattcttgccaaaacttgttatctttcatctttttaataatagcacatctaacaattgtgaggtgatttcacattgtgattttattttacatttctctgatgattaaatatgttgagcattttttcatatatctcttggttgtttgtatgccttcctttgagaaatgtctattcagatcctttgcccatttttttaatagagctattttgttttcttgttattgagtagtttgagtttcttgtatattttggatattaaacccctttatttgaggtatgatttgcaaatattttctccgaatctgtacgttgtccctttgcttcaattgtttcatttatgtgcagaagcttttcagtttgatataatcccatttatctatttttgctttagttgcctgtgcctttggggtcatatccaggaaatca

SEQ ID NO: 109397 - DNA, 415 bp, Homo sapiens
attttgttagacattttcaattttagagatttacatctttcagttataaaattttgtttttaaaattatgtctttgatcatttccatacaaattcttttgtttggtcttttctactgaaactcctgtaagattttggaactcatggcttttctaaataatttctttatgtttgtttgtttatgagtcctttgtctttttattcttttttggaacaaatttccttgaatctatcttttttaatttttacatttttttattttcaatttttgtgtttaaatagtaggtatatatatttatggggtacgtgagatgttctgatacaggcatgcggtgtgaaatttgcacatcatggaaaacggggtgttcacaccctcaagaattccttgtttttaatcttctaatccccttattgga

SEQ ID NO: 109398 - DNA, 298 bp, Homo sapiens
gaagttaaataatcaagcagaaaggccaagctcagaaaaggccagagctagatcagctcttgggtcgctggcaaggagttatagctggtttttgctgagtaccactatcttcatgaatgagcaacaaccattttcagattcattttcattttccaaaagaaccaaataccaggcgaaaagttttgcattgatttgggttagcatgtgactacatcagggtgaggaaccttaactgacaatcccaccagtcaatctctaataaggtaagtcccttaaaaatatatcttaaacgagactt

SEQ ID NO: 109399 - DNA, 745 bp, Homo sapiens
cggctttagacatttttagatttctcttagacatccaaatggagagaagatatttaaatccatgggattgaatgagatccaaccaagggtattgtaggtagagagaggaccaaagactgacacctagaacctttcagtgttcagaatgcaaggagacaggaggaaccaagagggaagattgaaaaggagagtccagctgggagctgtggctacacctttactaatcccagcactttgggagaccaaatacaggaagatcacttgaatccaggagtttgtagaacagccttagcaacatagcaagaccctgtctctacaaaaataaaaattaaaaaatttgcctgtaatccgagcattttggaggccgaggtgggtggatcagctgaggtcaggagtttgagaccaacttggccaacacagtgaaaccccgtctctactaaaaatacaaaaattagctgggcgtgatggctggcacctgtaatcccagctactcgggaggccgaggcaggagaatcccttgaacctaggaggcagaggttgcagtgagccgagatcacgccactgcactccagcctgggagacagagcgagactccatctcaaaataaataaataaataaaaatttaaaaagttagctgggcgtggtggcatgtacctgtagtcccagttactcagaaggctgaggtgggaggatcctgtgagcctaggagttggaaacttcagtaagctataatcatcacactgc

SEQ ID NO: 109400 - DNA, 845 bp, Homo sapiens
gagtttttcttcaatgtttgctacttatttattcattttgtgtttgctattaagcaagtggtaggagccatcaaaaaaaacatacatttaaaaaaaattatgaatatacattttgaaaaagtgtatgagagattcttaaagttgagaattctgcccattaactcaatttttccacttgtgattttggttaataccatatccttgaatcagaacatctcccagggttttgcaggagtgtactaaaaaatgtatgaggacctgatgtgtccttttaagaacctgtgctgtcatgggatacacgggaaggtcatccaatggcagcataaagaccatcaaatggggaacgtgtcccgtaggaagatatccccaaggacagaggggtagtggagtttctggatctcaccagggaggattgtggttcttattttagctccctctccttgatgtgcccttggcgtcagttgctattttgactgtgagcatcttcttgcagttgccgatgtgctgattgccagcagcactcaccgggagaaccagcggctgctctgcccactgcctccctgtcagtctttccgcatctctttgttgagcatggggctcatgcccatgaaacactgaaaacatacagtgcaggagaagagtcccgtgataaaaaatgagtctgattttagagggaaaagtccatatggaatataggcgtctctcaaccagggcatggtggctcacgcctgtaatcccagcactttgggaggccaagcaggcagatcacttgaggtcaggagttcaagaacacgctggccaacatggtgaaaccccgtttctactaaaatacaaaaattagctgg

SEQ ID NO: 109401 - DNA, 292 bp, Homo sapiens
tcaagggacagggtcttactctgttgcccaggctagccttgaactcttgggctcaaccattcaagcctcagcctcccgactagctgggactgtgggtttagaatttgaatccagtgttcacccttcctcctgagcggtgctgtacattatgaacaggttgtttgccaggaactgggataatgccattttcctcataaacctttgccccgcaagcatgggtagacagacagctggtgctttccttggttatatttggcaaactatataaccaaaccaaacttgattatatttg

SEQ ID NO: 109402 - DNA, 944 bp, Homo sapiens
aaagttggggtggggggaagcaacggaagaatgatggaagggtagattgatagagtctagaaaacatttaaaggacaaatattttgtcaaagtacatttgagattgtgatatccggttaaatgaactactcaagactgtttgtttatttatttatttttttcgttctgttgcccaggctggagtgcagtggcacaatctcggctcactgctaagtctgcctcccgggttcaagtgattctcctgcctcagcctcctgagtagctggataacaggcatctgccatcacgcccagttaatttttgtaatttttttttagtacaggcgggtttcaccacgttggcctggttggtctcgaactcctgaccttaggtgatccgctcgcctcggcctgccaaagtgctggggattataggtgtgagccaccacacccggcctactcaagacttttgagcaaagagttagagcctcagcctttgagatgccctattagaagtcccttaaaaaaaaaattgtaggaatttggtttgtttgcccccaggatatatattcttccagaaagttattaggaagaaatttgtttttttaatgagaaataaagcaaaataaatttctagttggttactgggttttgacaaatttcggctgggatgagaataaatgtgaagcgttagaaacattcttcccatgctggaatggtagaaattatgaaacctacatagaatttaccataaaatgcagataatccttgagttttctgtcagggaaatgtgagtgctaaaaatacaatagctaaaataaagtttcactgtattggtttaatagccaattagatacactaaagatagaattagtaagttggagaataggttagaagaaaatatctaccctgagacagggaaaaacaagaaaatgacatatacagaaaagagcatatgagacacag

SEQ ID NO: 109403 - DNA, 1194 bp, Homo sapiens
caagatcctgcctcccaagcctataagctttaccaggagagaggcaggccccaccccaagatccactatccactctttgaagaaagattagagccatgttctcagactttgggctgcatcctaatccctgcgaagtgcacaatgtgtgatgactccaccctccacccgatccagagggtctggggtgagacccaaggctgagaggcctcgatggcttcctggccccatctccggcagcagcctctatggctgggctctcctgcaggctgggtgcaccccaggccctcagatggttctaaccagaatcgatgggcagcagtgacttcgactgtatcatcaatcttggctgccacaaggttgggtgtccaggccctcagctgacccttgaggtgggcccccacacagagctttgctctgcccccagcccaccctcattcatcgcccagaccacggccagggacccagctcctcatgtcccataccctgctctcacctcatcaccagtgcaaccacagcaccgaggcctgcctggcgggggctgtggcttgatgcttgggatttcatgagaagtctctctcctcccgactgacgtggttgcacaagccacagtgtgcctggccacccccgctgggaccgcctgcagctcggccatttcccccagaggcgctctgatctgccctcctgcctcctctcctgttcttgttagcagagagccacactctgggagctgtgtagacccagggcctcagagagggctggaggatggcttgccagccaagcgggtcagtttggtgagcacttcagaatgagacgccttgatttgtttccctattccaagagtttaccatctggatttagccatgcccttgtaatgaccccaccaatttcatgaaaaatggaatctgtgaatttgctctttaaatcactagtcatctctgttcatttaaaaataaaattatagttccttaagtttgtattgctaaaggcatcagaagaattcatcttaagcaaatagcatgtgactattttgccttatgagatggtgtatttgggactaggatggccatatatcaatatgtgacaggatatcgagatccaatgttagccagagatctcaattagtcccagttttgttctcataattcattttaattcagtgaatttttagatacttttttaagcccttgaagtttt

SEQ ID NO: 109404 - DNA, 979 bp, Homo sapiens
tgcgtgtgtgtgtgtgtgtgtgtgttgggatcggcttccaaatcttcctactgggggaatgcccattatccattagatgccactcagtgggaagtggtgccccacccgtccgtggagacctaaggggcttaatagatcctccctgcatagccagagacggatacaatctgggctcagtgaatcggtgctttgactgctcacagcgtagctgagagcttactcccagaatggcgaaggtggcaaagagtccccatagctggtgttgttggctgccatcaccccttttatccaggggcacagctgaaatctgtgccactcggctctgctgggcaggtgggataaatctgccccagcctctgtgctgtccccatccctgctcctgctgcccagcagcctggagtccttctccagacttcctgtaactctctccccaagccaatgccctccctcgggtgaacaagggcccctccttgtgacccatggtgcctggcttgccttggccccagccctcctccctgtgccgaaatcatctctctgtggacctttctccctcatggactcccacctccttgtgggcaggaaccagcccttggccatgttccggctccctagtgcccagtatgtgtttggtgaatttgggggcatgggttggatgatcttggttcagttaccaaatctttctttcctgtccaatcagtcttccaggatctcaaccagttctctcactgcagagtctggagaagcccagccctcattgtgaagggagagccaccgtggtgctcacagcaagacacccagagtcccttccagacagggacacccctggagcgaccctgtttcagaatgaagttatctgggtgggaactcaccaagaatgcacagagggcgctgggctccaagcttcagcatatcctttcactggactccacacaggcctgcggagcaggtggacccaccattctcagaccccccagggccc

SEQ ID NO: 109405 - DNA, 111 bp, Homo sapiens
tgatgggttaaatcaggcagcacagggtttgtgtctttctggttattttctttttaccatttggagtcatagaacctgaacttcagtctttgaaatttgtagtcttccagt

SEQ ID NO: 109406 - DNA, 652 bp, Homo sapiens
tgtaatcccagcactttgggaggctgagtttacattctccccttttagccaagatgtgccagagatgacattggtgaccaaacatttattttttcccatatctttgccggggtggtgtggctacctgctgcaggttcattctgttctttggtgggatccttatggccaagggacttggagccaattaaacattctaggccagatgaggatggaggtgaacaggcactcattaacccttaaaaaccttttgagcaacagaagagccaaaaagcaaggttacaacagtgacttacctgtaagttctatgtgacgagtcatcagctgtttagtaacctgtatgacctgttaaccatttttgtagcctgtgaatatcagatgttcatttaagtcagaaccttaaacatgtggatatttttgccaacaactcagaagctaacaaaacagctaacaacttagctgttttcattgaaccaacaatattaaattagtcttatttgtcaaaaaattcacacaaagatcattctctttttgactgggtttatagtctaataatcttttgtgccaaatcctgataccttaaaacacctagcggaggcaaatataaaataatcagtaaacccagactaaaaaaaaaatgtatgctgacaattct

SEQ ID NO: 109407 - DNA, 236 bp, Homo sapiens
tcctcaacgtatagtgagtgtcctatcaatggaaactttaacaaaggagctagattttggttttacaggactcttagatctatggattaagatgtgtctgtaatattagatgtatcttagagaataattatccaaaatatacttcatggaacatggaggaactacagactaacattttctatggtaaaatatttgggaaatgcttcattttttctttcataatatattaacacgtt

SEQ ID NO: 109408 - DNA, 1126 bp, Homo sapiens
gaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaactagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcatgaggctttattagagagaacaaaacagcaagagaagatggagtaccaggtctgtgcagctgatatgaatgtcttgaagagtcatgtggaacaacttgtccaaaatcaattcatatgaaagcttttggagtccattatcctccccctctaccccctttaaagaaaaaatataaaacaatgataaaaaaaaaataaa

SEQ ID NO: 109409 - DNA, 2267 bp, Homo sapiens
gaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaactagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcatgaggctttattagagagaacaaaacagcaagagaagatggagtaccaggtctgtgcagctgatatgaatgtcttgaagagtcatgtggaacaacttgtccaaaatcaattcatatgaaagctttcagagtaaatttttttttctagctataagcatgcaataataaatctcaaacactgatttggagtacagtagcattttgtcttttatgtaaatatctctatatctgtttggaatttcaaaagtctgatctctagggctgacatgagaactccatgtcacctcctcagatctttaatctggaagtgacaaaaggtaacacagtgcacggacctttgagctatcatacttttgccttctgctcatgaggggtgtatcaatttccactcccacaccctcactgttatgtggaccaaaatgtctggtatactatttggcgattaaaatatttaagcccagttttcaggtactacatctgtaactagtgaatactctgttgattagaaagttaatttaccactcaaaatggctaacttgaatggaggaagtagtaaactcttctattaggatttgggccagtgttttttgtttgtttttttggtgcagtttcagctcactgcaacctccgcctcccaggttcaagtgattctcctgcctcagcctcccaggtagctgggattacaggcatgcaacaccacacatggctaatttttttatttttaatagagatgaggtttcgccatgttttccaggctgatcttgaacctctgacctcaggtgatccatccacctcggcctcccaaagtgctaggattacaggcgtgagcctctgcacctggctagggccagtgtttttaaccctcctcaaattccattttggactacaactaatgtgtatctcacactgtccaaattaaagatgtactctgtccttcactctcctttggatgtgtacggttagggtgacgatgtttgaaaatcaacacataactgaaatccaggatgaaacagtaagcagaactacttagaagtgaatacagaaatgatctatttcaagaggaaggttttccaaaattaagagtacttgagtagtctcaataggagtgtatttgtagacagcagtttccctatattatttggagtcaattcttacgtaatttgttgtttatttcttcagtgaacattgtctttttctggcagctgaaactgcacacaactgatacacatatttaatttgtattcctttgtagtaatacattttaaccatgatttatgtttgtgaatttactggatgttttctttctgaattaaagattgtcaagaccaattagtgtaa

SEQ ID NO: 109410 - DNA, 211 bp, Homo sapiens
aagtggactctgaaataaataactggtagaaattctacagtgtggaatttcttgcagttagcaaaagcttaggggtccaggtttttgcaggattcctgtcttggtcctttcaaaccaaggagctctgctggctctgccaggccgcctcacatgcccagtgggattctgacccggcctccttggtgcggcagcttctcccgttaacggaaga

SEQ ID NO: 109411 - DNA, 279 bp, Homo sapiens
gcggagtgtctggttcaaggccacgcaaccggcaagaggcggagcctgcagagccaggactctgcctcctgcgtctctcggtctccaggtggaatgtggggcctcatgttggcccctccactggcctccctcacagatgggcacagggagggcagggactggggccacggaaacaggtttgggtctctctcctccatcccccggtagccacctgcaggctcagccatagcagggtttaataagtattcagcaaatgaacgacatggcttcacaactgtg

SEQ ID NO: 109412 - DNA, 404 bp, Homo sapiens
actccaggccctgcaccctatggaagtgtttaggagaagaataaactacatgccggcttataagacacactgtgggggaaagaaagggacttggcagcaggcaggatgtctgtggtccccctccctggccagtcattgcccctgaaactcctgacaaaaccttgactctagaagaggaatgggagggggctggagatgaagaaggcggcctcggcccgggcaaatctgccctggcagctctgtccagctcaggaaggggtgggctgtgccaagggctttctgaaaatgtgcgtgtgtgcgtgtgtgtgtgtgtgcgcgtgtgtggcttctgcaaaggtggctggcagggctgaggggggttgcagcagagaaagagaattttgcttcagaatgccaagcccttc

SEQ ID NO: 109413 - DNA, 268 bp, Homo sapiens
tagctgggattacaggcacctgccaccacgcccggctaatttttgtatttttagtactgacagggtttcaccatcttggataggctggacttgaactcctgacctcatgatccacccaccttagcctcccaaagtgctgggattacaggtgtgagccaccacacccagccaacctagtattattttctaagctcattttaataactattcaaataaggtcttcataacccaaggaacacaaaacaaccttctatttctccagattgcc

SEQ ID NO: 109414 - DNA, 314 bp, Homo sapiens
gaagacttcttgtctcacatctgacctgcatttaaccaataatctttaaggctgtttttatttctcaaagattaaagtcacgtgaactgaaaggtaccacagcttttaactttccttaaaaaaatacttgatccaagcacttgtttttctttagggcaaattaagtagagctctttttacagacgttacacacaatacacacacagagagacagaagaaaacccagtcttcacaagatcctttttcacaagcaaaactttacagagtacaaacagtgatagttgggggacctggcctagtaaaaaaagtcttcc

SEQ ID NO: 109415 - DNA, 423 bp, Homo sapiens
gcaaagtggaccagggaattgcttcatttgcttggtgaaaaaaaccaaacagaactagacagttttctaagtttggctggaaggacgtgcatggatgagatgacctttcatatactctctgtcccggtccctcagacactgggttttcccattttcacactatcttgcctaggacaccctttctactggctgaaatcctatctatgcaccaagtccaaagactctccctccttcaggaagtccctgactgtccccagaaggctgtttcctccctcctccaagtgccctgagggctggcattggattgcctttgccatggggttctgctgtcgggaatgcaggcctcgtctgctcaaggggaggccatgcattcagcatgcaggtgagatgcagcacctggcccaggccttgcacacgcaggtg

SEQ ID NO: 109416 - DNA, 347 bp, Homo sapiens
atatgatcctgcagactttttctgttcctttgcttaacacactcatgcttcatgctccaatcacagaaacatcaagttcccccagccggtcagttctactgccaataaacatatagctttttctctcctcattgcttccatcctctggtatgcctgaatctaccatccacccttggtgaactctgaattatgcaggactcaggctaaaagaatccaattaggccttctcaggaaaccccccccctgagcaagcttagaaaaggttagccatgtccccacatccattcctctctagctcccttctctgccattatgcaaatgatcacagcttggtctctcagtttacc

SEQ ID NO: 109417 - DNA, 487 bp, Homo sapiens
cttaaccacagccaaccaattgcactgtccttgtgatgactattgctcccttatttctcaaatgcctgacacatggcagctgctagtgcatcctcttccatgggtatacatcccagggtgtacatccaatggaaggaggttatgggttaaggcaaaattgtgaataaggataggaggtgaagatagcagatgaaaaaattggaaacccctgagtgtttgtccagggactcttatctgcctggattattttccccatatcctttacctaattaaactctaaacttacccttcacaactcagctcacacaagaatcaatttcactctaaagtcttcatggaccctttccaagccttagactggattggttgcctgccttgttattcctgtaactctttagccacctcaatcatataacaacacactaagcatctgctcacatatgtctatttcaatacaccagtggttttcaacctcagacatacatgt

SEQ ID NO: 109418 - DNA, 675 bp, Homo sapiens
aattggcctatgttttctcagaagtcatgcattttggctcaaagctgaaggttggattattttgtgaggttagtcagtaagttaaatttagaactagaattttgtgaatgaatcccaaggctgtgttggaagtcttgaagatgtgagagaaatgtgcctgaagtctattcatttgctaaagtagatgtcattgcaaggaaatgaaaaacaaagaaaaaatgaatccccagaaattatgtaatctgcgttatacatgttatctatcatttgtgcttgtatttcaaagtcaaatttcaataatgctttagtaacaatatactaaaggattccttcatttttcagtgtcatacttttttaaaaagaggtttttaatatgagaggaaattttaactagtgaactaattattttaatttgatataatttttctcatttgcatttttgacaattatttatgactattgataattagaggttgtatgtctttcagaatactgtaaacagcagcatagacattagctgaatcattaatttcaactgaggatgaaacattttatacttttgaccttttataaaatattcttctatttgaagcaaattgcttgtcaaaatcatagctatttgcccaattggtatctggcatcgcaaatgagctcttgacttatatatagcacatt

SEQ ID NO: 109419 - DNA, 517 bp, Homo sapiens
tcagtagagacagggtttcaccatgttggccaggatgacctcatgagctgcctgcctcagcctcccaaagtgctgggattacaggtgtgagccacctggggattctttttacagcaacattttgcattgagatttgaagtcttacagatttttatgattatctttgctaagaaatggttgtgagctacattttacttgcaagtaagttcaactacctttgattcatggcagaaaattcctttgggactgtaaagttttccagcgcttcatggtgttggcgttcagcagcagtgggaccatggtcataggtgacgtgccctggccccttgtgctggtcattagggatacagctcagtgtatctcatgaactcaaccgtggtgccttctgagactttaaattcaaattatttgtatactctcttgttcagtgattcttaaaagaatttgttttgttcccaaatgtcttctttttaattgttgtagaagaaatgaggaacgagtgaaaagttaatgagca

SEQ ID NO: 109420 - DNA, 253 bp, Homo sapiens
tttcagtcttatttaagcgactgaaatgagaaacagaagacacataagagaacccagtcccagcagaggcaggcagagaaggaaggcctgcgggggctgaggtctggagggcagtgtatgccgctctggcccccggcctcacagagagcagccctggccggacatccaccccatggagtctagaaacagctctgcagcagcccacaatcacctctgcttttcatcacattctcaagaataaggacacgagcct

SEQ ID NO: 109421 - DNA, 350 bp, Homo sapiens
cagccacccaggagctggccctgtccccatggataccttacattcatgtctccgggctgccccacctgccctctgtctgatacaaagggtcccactacccgcctcatgaggttacttatcatcaaaaagcgttaagtgcagagccatgaggtacaacgcaagtgtcagctgcgctgagttggccacgcaatccaagaaccttcctgagacctggcatgccctacgagagcaccaagatgctgcccagtggccacatacaccctctcagctcacaggtaccacattatccaaaacactcccagcagcctcacagcacctggcacctggtacacctgcaccagcaacgccca

SEQ ID NO: 109422 - DNA, 425 bp, Homo sapiens
ataaaatctactgtaatggggaataggaggtttttaaaaaattcttacaacttagttttttccctgtcacataggctgtcagtatatcctaacttacagaagtgattgtgattgtgtctgggtgttggaattatggtgattttaatcttcttctttgaaagtttttgatgatgagtatatatttattttgtagacaaattaacaatttttaattaaaaatttaaattataccaggcttggtatcgcatgcctgtaatcctatcactttgggaggtcaaggtgggaagatcacttgagcttaggagtttgaggccagcctgggcaacatagtgagaccctgtctccatttttatataaacaaataagcaaaaattttgatgaaaaatttttttgtaaccaaattaaaatttatgaatttcatttgt

SEQ ID NO: 109423 - DNA, 182 bp, Homo sapiens
gaacagagggcagaatataaaatccattattatgacgatgaatctagcgtcataaatgtggcattagttgacatttccactagtttctggtatttagaagtcatttatccttccgagagaaataataaagtttcatctactgagaaatgttttaatgattctcctcaaattttaataagtat

SEQ ID NO: 109424 - DNA, 472 bp, Homo sapiens
aactctcccagttctgagatgcccgagcctggacgctttgtcattgtacaccatcaactcagtgctgccagtcattccagcagccagctagcgtagctcagggtttctccaccttagcactgttgacatttcgagccagataattctctgtggtgaggagctgtcctatgccttgtaggatatacaacagcatcctggcctctacccaccagatgctggaacacctccccagtcgtgacagcccaaaatgtctatagacgttgccacgtatacccaggggttcccagctgagaaccttagctaaagaaactggctgcattaggagatatacctaatgctaaatgacgagttaatgggtgcagtacaccaacatggcacctgtatacatatgtaacaaacctgcacattgtccacatgtaccctaaaacttaaagtataataaaaataaaatttaaaaaagaaaaaaaaaaaa

SEQ ID NO: 109425 - DNA, 367 bp, Homo sapiens
ccataattatgtttaattctctagtacctagcagtgcccgacaataggcattcagtaaatattcagtaaatattggatgaacagaaactaaggtaagctctgccttcatgggaattatagtctggtcatgaaagcaggcagaaaacaagcaaataaaaagatgtaattgtggtaaatattaagaaagttaaaagggggagaggggtaaaggaagggttaccaaactacagcagaaactttcagaggtaggtgatggtgttaaaacccaaagtagctgtactaactttgcttattcatccgaagagactggaggtggtaatcataaaagattccgtttacattttgttccattcatcattttaacaca

SEQ ID NO: 109426 - DNA, 624 bp, Homo sapiens
tccaaggctggttcattggctgtaatctagaaccttctggttagctaccaccactcagatgtcgatgaagcgagctatgttgtgtaaataactcagttatcttctctatcgttactagtccttttcctcttatacgtagctttttttttttttttcatcctggtgaacttatgtatcccatttagtgtgagatcaccatgagttcttaagaatgtctgtattgcaagaaaactgcctttggatgcttcatgcctgatacgctgtaagaggagatacttttaagtcatttttctcaactgtagtgagagactagtatactttggggttgaatctaagtccttggaggccagcatatttttgcatatgcgtgaatgtagaagcaaatgactggggatattgttaagccatcagagcttaaaacatacttgactctgtgccaggggtgctggatatttgtccccagcctatagccatctcctaaataattgatttaatttttcctgcttaacaatgaataagtgattgtgcttgggtattaaacagagaaaaataatccaggccttgctttattaaaaactgaatgagtttaaattattcagacatagaataaataggaaagaaggg

SEQ ID NO: 109427 - DNA, 237 bp, Homo sapiens
gagctcaacagtggatgtgaccatctactagtcagtaggtgtgattagtcacagataccaattcatcatgcactcaacaaattcttacaagttaaacccctatacttgtaacaaaagacagcaaagacctaaagtggttataaaatgcaggcatagataaacaagtgtttgtacaagcacagcaaatagaaggatacacacctaagttgtatcagcaattatcaatgaggaatcaac

SEQ ID NO: 109428 - DNA, 143 bp, Homo sapiens
ggagaggcagcgtattactccttacctggcctgcctggcacatacgagacattcaactaacatttgtggaatgggtgaatgtagacatggctcaaggctcagagaagaataccttatatcatgtggcgtggcaatgccagaag

SEQ ID NO: 109429 - DNA, 865 bp, Homo sapiens
gtcatgtttaagtggggataatgacattggcatacctgcttgctagagttaatgtgtgggtcatgagataacgaatataacaaatatttggaaaagtactatgttgaaatattttaaaataaaatttaaatccctcttcatttagaaaggatttgaggcagctaaatgcagaggtgtaagatggttttttggttaggattgtttctgagctgtgactctgtagtcactttcttactcagccctgccactcagctgtattcctctgtagctctgggcagacgactctgaacacggcttcatattggccttccatgagtgggtgaagggcatagtcatctggcagttttacctgctgttctatgcatgtctctccagcgcttgcttattttccccttctgcaaacattccattcatgccatgggcattcagtacagtcctgtaagcaagggtaggggcggcacaccaggtggatttaagcgcaaagacaggacgactgctttgccacaggcgcctttacagccagcagtgaacagttagacatattcaccttcctctaggtggaaaacagtcctcttctcagtagccctctcatgttcttgagacccatttgatataaataacaatgttgcaggaaatttcctgaaggaactgaaatgaaccatagaaacgagatcgttcttttcctaccacacagctgggattagactgcttagtttgtacttgcagcacttttgcagtatgggccgtattaaaaaaaaaaaacatttaacactcagctatgggtacaaagatagtcactgaaacattattatttacttttatttatatatttatttttgagatggagtctcgctctgtcgccagg

SEQ ID NO: 109430 - DNA, 3324 bp, Homo sapiens
gtcactgtggttttggcttccctgatgctgagcatctttctatatcctttttggccatttgtctatcttcttcagtaaaatctctattcagatgtctgtcttacctattttttttcagacagggtctcgttctgtcactcagcctgagtgcaatggtgtgatcacagcccactacagccttgaactcctgggctcaaaggactcttctgcctcaacttcccaaggagatagaactataggagcacgcaaccaggcctggctaatttttaaaattttttgtagagacaggatcttgctatgttgcccaggctggtcttgaactcccagcctaaagcaatcctcccgtcctggtctcccaaagtgctgggattacaggcatgagccacgacgcctggcctatcccttctttcaaccaaaccttctttagttctctctcaaggcgattcggagacatttacccaaccctccctggagagaaggggtcgaagcaacgcaggggttaacttttctgaaaacacaattaactttttccaatcctgcgtggggtgggggagagacatatttatttaatcacccgggagtggggtggtctcaatctaaacgttccctcctccctcaaaggcactgagcctgtttcacagatcctacgtaggtggaacaggacgcgttgtgttgttggggagagagaggagaaaggcgaaggagaaggaggaaaaaaaaaaggttgataggtttgtgcgcgggtccctcgtgcgggctgcgctcctcctgggtgctatttgacaattcctgcctctgccattggtcagtgttggatcagatggttgtatttccttctggccctcactggcacctcgccatcccccctcagctaaaacccaatctcggatatactactaataggcgcggcgctcggactataaaacacaacaaatcataaacccggcggagcagcagcgccgcgcgcgcctcccctcccaatgagttcctatttcgtgaactccaccttccccgtcactctggccagcgggcaggagtccttcctgggccacgtaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagtgagtgagacttcccgtcgccgtcgccccggctcccctgggcgcccaccccgggacacagaactagtgagcgccccctgccccaatctcccacagggtgctgggtgggcatctcagttaggagatagaagaagattgggcgccggccgggggtctctcgctgtgtcccctattaggcaggagttacaaagtttgcaaagtcccagccgcactgggagccatggggagcaagtgtgctctcctggggcgcctggccagagccggggttccaggacagggaagggagcaggagcctgcagtcactggcttggctttactttgagcccccaacccccctctcccagccctggtagggttccccaaccaaagacggctccattaaaaacggagtgcgtcatgcaagggggtagggggtgacgctgaagaggaagagttgagtctgtctgggactgtgtttccctgtggtggggagctggggcaagatgaggcaccaggaaaggggtggtagtcagaggagggaggaggaataaggggaaggaagagagagggagcaggcggagcgagagagggagaaacaggcgcggggtctcaggttggattatttgttggccttaagtcccaactgatgtccattagccggactcgaaagtgaggagccgttaatgtggactatggatcgatctacgtcattacggattaacggcctggatttatcattgggttggggggatgacggggggtgggaacaagatggatggaaagggagggaaagacaagatgcaactaggaagagacacacctgaccagcccctccccccaggctcaggtgggagttcaaactgctcctcccctcccccatctagagtctagacagacggcacaggcctaggagactaggagggaatctggagggggcgctggaggagtgcgaaacgggggaagggagccggcagaatagagggcatcccggtactggctggagtctgtgttcgagggtcgactaggggagggggtcctgggcccggtgaccgcaggcctcagcatctccactctgcgtaacaggttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccgagggcgtcagagagacccgggaaggaaggctctcgggtgggggagccaggagacctgctctccggcgcagacaggcggggccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgatg

SEQ ID NO: 109431 - DNA, 217 bp, Homo sapiens
agggctaataggcggtcaggtaggtagatatggatgggtgggtggatggatggatgggtagatggatggatgggtagatggatggataggtgaataggtggatggatggatggatggatggataggcagacatatagacaaataagcttcccctacacccttcacttcacctggaagtgaataaacagactggtcatgccagttctgtatatctgtt

SEQ ID NO: 109432 - DNA, 792 bp, Homo sapiens
tttataggtgtaaagtaacaacagtaacctttcctcttacttgctcttttagttcacagcaataccagtatgtaaccaaaagacaagctagagaaacttttaagtacctttctgcagttctaatttgaaccttcttgcataaagaaaacacaagtttgacttttaactgtgcttcacttattatgcttggaatctagaaaacgacttctgaggaagtaatttttttcccctctcatggaaagtctctagggaggatgtcattacacactgtttaaaagaataatgttttcaaaagaataatgcttccgtttgtcctgcatggatgctcttactaggatttaaacttgctttatgtgacagattctccatttacttaacctcactcaacattcctctcttttactctttctcactcaaaaggatgaactgtctgaaatgatcaaaaggaaattttgaaagaaaaaaaaaaggaaaattattctttgaggttaccaagcaaacctgatctcagatccaaactgagacatactttctaacagagatgaaaagtgcaagtgagtgccaaactcgcttttcttttgttttcattaggttaaggcttgacaatacgttagtcgccacagcatgatccagtgtaacatattagttcattttaaagtagtctttttaaaatacgcatctttaaaacaaaatgaattaaaattatgtgttttttttttttcttctaatgaacctggtatttatttccttaaaaagaaacttcctcaggcagtgacttaagtggttaagtga

SEQ ID NO: 109433 - DNA, 153 bp, Homo sapiens
cattaaaaaataaagccaccccattttggacgaaggagggagaggaagtcagaatgacaccccactccccatgctggctgaggatgggggggtaccaccaggtgcccccaagcccgatgctggctccccagggtttccagatggaggctgggg

SEQ ID NO: 109434 - DNA, 1073 bp, Homo sapiens
ggcttttttttttttttcctttttttgtggagacagggtctctctctattacccagattggtctcaaattcctggactcaagtgatcctctcacctcagcctcccaaagtgctggagtgctcccactgcacttgacaaggtgaagaacttacagctggagagtttaatgccagcaaaggatggtttgagatatatgtgtatatatatgtgtctatatatatacgtacaagcctgtacagtatgttattgtactgaatactatgacaagtgtaaaacaatagtaactatatatgtatctaaacataaaaaagatacagtaaaaatagtgcattgtaatcttatggaaccgctatcatgtatgaagtccatctttggccagaaaaggtaattatactgtgcatgattgtaatttaagtaattttcatctctagattacttataatacctaatatttttgttttgcagttagttgaatccatggacatgaaacccacagatatagagggttggcccggtgcagtggctcacgcctgtaatcccagcactttgggaggccaaggcgggtggatcacctgaggtcagaagcttgagaccagcctggccaacatggtaaaaccccatctctactaataatacaaaacaatttgctgggcatggtggtgcacgcttgtaatccaagctactccagaggctgaggcagaagaatcgcttgaatccgagaggcaaaggttgcagtgagcccagatcacaccactgctctccaacctgggcaacaagagcaaaactccgtcaaaaaaaaaagatacagggtcaactgtacacattaaacacttctatcaactagtgatgtcagtcttgtccattgtattattgcctatcttactaaacagtcatatttcaggaagtacaatatactcaaaaactaagttaatgttctttgtagatttatggttaatggatgattcatataatagaaacttaaatttatttgaccattctatttaatatagaataaatacaactagccaggcatggtggctcatgtctataatgccagcacttggggaggccaa

SEQ ID NO: 109435 - DNA, 1151 bp, Homo sapiens
ccccccttctattatgcgtgaagtccatctttggccagaaaaggtatttattctgtgcatgattgtaatttaaggaaagggcatctctagattacttataatacctaccacattgcggccagacacggtgtctcacgcctgtaatcccactactttgggaggccaaggcagacaaattgcttgagtccggaagttcgagactagcttgggcaacaaggtgaagaacttacagctggagagtttaatgccagcaaaggatggtttgagatatatgtgtatatatatgtgtctatatatatacgtacaagcctgtacagtatgttattgtactgaatactatgacaagtgtaaaacaatagtaactatatatgtatctaaacataaaaaagatacagtaaaaatagtgcattgtaatcttatggaaccgctatcatgtatgaagtccatctttggccagaaaaggtaattatactgtgcatgattgtaatttaagtaattttcatctctagattacttataatacctaatatttttgttttgcagttagttgaatccatggacatgaaacccacagatatagagggttggcccggtgcagtggctcacgcctgtaatcccagcactttgggaggccaaggcgggtggatcacctgaggtcagaagcttgagaccagcctggccaacatggtaaaaccccatctctactaataatacaaaacaatttgctgggcatggtggtgcacgcttgtaatccaagctactccagaggctgaggcagaagaatcgcttgaatccgagaggcaaaggttgcagtgagcccagatcacaccactgctctccaacctgggcaacaagagcaaaactccgtcaaaaaaaaaagatacagggtcaactgtacacattaaacacttctatcaactagtgatgtcagtcttgtccattgtattattgcctatcttactaaacagtcatatttcaggaagtacaatatactcaaaaactaagttaatgttctttgtagatttatggttaatggatgattcatataatagaaacttaaatttatttgaccattctatttaatatagaataaatacaactagccaggcatggtggctcatgtctataatgccagcacttggggaggccaa

SEQ ID NO: 109436 - DNA, 595 bp, Homo sapiens
agattctcttccattttcaaataggttatttagtcagtcaatgggtggccatcgttaatgcttgttgcaagtttgctattccagagacatagtgcttgacttctatatatttaatattactacaagagtcagtagtatatctacatagctatctgcagttcagggtcaatataatttgatagtatttaataatcataacttcattttgctgtactaattacatttataatttgaccaaatcttatataatcatgaagtatatatacatatgtgtgtgtatgtgtaagtaacttgctacagtcacttatgttgctttggccctctttattctagttgctttcacttgagttatcaccattgtcaggttgtcaaagtaaattttctttacagtcttgctttgctcgtgtcctttttttttttttttgtaattgttattatctttcaatttttcttctttacagtataaacaaatcccaaggtcaaaaatttgtaggactgatgctcactgaagtcaaaactacttttagttatgaggaagaggatccttatcctacaagtacatgacatcacctgattataactagcctaaccatca

SEQ ID NO: 109437 - DNA, 654 bp, Homo sapiens
ctcttccattctctttatttgcttcctcccactctgactctagctatactgaacaccttacaattctttgaatataatgttctctttacctggatcaatgtttgactttctgtgtcccctatgtgtcccattggcttataacttcttttttccccctcaccaaaagttgtatgaaaagatactgtagtaccattacatcctgttttacatggcacttttcatgtagtgtagtgtttactttgtgaactctttaatgtcttactcatctttgtgtctttagtttaacgtacacattgttgtataactgagttaaacatcttagtcttcttgagaagccttgtggtatggtagagactagatctgaagtaagatagatttggttcagatcccagcagctccaccatttaaaggttatgtgggtcttgcagggattacttaacccttcttctctggtcctgtttctgtaatatgggaatcgtagagctcataaacttgttagaaggactgattgagatgggtgaggtttttattgtgcagggcccattatggtgctccatagatgttagtactcttttctttcctctgtattgaatgaaaattgaattgcttctcagagcccctcatgctatatgtcattgaaataagtagatatgg

SEQ ID NO: 109438 - DNA, 605 bp, Homo sapiens
agttttcaacaataatttataaagcaaacaggaaagtatggcccattcacagggaaaaaagtagttgatagaaaccatctctgaggacacattgggcatactaaacaaatgctttgaatcagctgtcttaaatatgctcagaaagccaggtgaaaccatgggcaaagaactaaaggaaaccaggagcacagtgtatgaacaagtagagagtatagatagaaattaagaaaccagccaggcgcagtggctcacgcctgtaatcccagcactttgggaggctgacgtgggcggatcacttgaggtcaggagttcaagaccagcctggccaacatggtgaaacctttctctactaaaaacacaaaaattagctggatgtggtggcgggcgcctgtagtcccagctacttggaaggctgaagcaggagaatcatttgaacccggcagatggaggttgcagtgagctgagactgcaccactgcacaccagcgtggggacagagcaagactctgttgcaaaaaaaaaaaagaaaaattaagaaaccaacagaaattctgtaccccaaaattacaatagctgagatgaaaaatacactagaagaattcaata

SEQ ID NO: 109439 - DNA, 513 bp, Homo sapiens
tagagtctgttaatggctagggcccatcatcgtggtgaatcacctaagacccagggaagagtggcccagggtgggaactgtctgcctgtgggccacatcacccctagtctggtccaaggagctcctgccaggctttctcagagggtcctggactcactcccctggggcaggcccggggaggctggggaccaactctccggccaatgccgcttggccagggaacagatgaaggggtgggggataggagctttctggagcctgcactcctccctggctcctgggtcccagccctggagcaggaaggagggagggagggccagtctttgtgtactttacagatcacagctgccttgagcaaacgatgccagctacccacccagctcggtgattccaccaaacacaaacagctgcctagcctggccacctcctaggcaaacaacccagctggtttgcagggcaacaaggtcaggcagtccccctcagcctggggcctggccaacagcagctcctcct

SEQ ID NO: 109440 - DNA, 342 bp, Homo sapiens
aagaaagtacagcttcaaaaatctaagccatttgtccgatgcagaacagcatttgacaactatggaggtgactctgatgacctggctctacctcagcatggggccctgtgtcattgataagtgtggtattagccgcctgattcgctaacccacagttcagagcaggggtgggccaggcagatattagaacagaaatgaggaccaagacttgcttaaataagcaggcagcaagctcggtgagcagacaggatccaggtgacgcggtgcagtaatgtggggttgtggtcagcaccatggacagctcccctgttgcttcatattgaggaataggaaagcgccgct

SEQ ID NO: 109441 - DNA, 337 bp, Homo sapiens
tgggaggaggtggatgtgggggttcagaaatgcggaagtttatcttgcgggcactagggagccgttggaggtgtgtaagcaggagagaggtcggctcagatcttcactatggggctgtcaggacaaggcgaggatggagtcattcataggttcaacaagtgtttgctgagcacttactctgtgccacgccccagggagacagaggagagccagacagacaaggcgtgcaccttggggagacagacgtgaccacacaaccaccaccacagggtgagggggctatggtgggggctggactgggtaaggcacgtggcctggtccctccaaagaggaatcc

SEQ ID NO: 109442 - DNA, 487 bp, Homo sapiens
tcattgatatttggtggttttcctatgtgtttagccatttattttctaggattcttgggctccttgatcataagaattaggtcctttaacagttttggttggaaaattctcagctattgttttttcatatttgctttctcttattttcgccttatgaattccaagtagatagatgttggaacctctcataccgtctttcatgtgtcttaaactctttttaccatatttatcttttggtatctgtgcttatgttaaaatgtatccacaggattttaatgtgtagaggtgacagagtgaggacatggagtagtcagtgccactgggaagaaaagtttattactcagtttcctagaagtgagaggcattgcttgctatgcagaagcacatggggcagccccagagctggtcaggaggcagggtaggagtgaaagagaagcacagggcatagccgtttttggagtttctgtgggaaagtcaaggcagggca

SEQ ID NO: 109443 - DNA, 179 bp, Homo sapiens
caatgtataagacagtggaatactatgcagtactaaaacagtgaagcgatgcaacattacaaacaaaaaaaccccgaaaaactgtcccatcctagttcttcccatttctgcttcccgctttccagcagtcccatcccagctgttcgaatccactcttgtagctccgcccctgcctagcc

SEQ ID NO: 109444 - DNA, 900 bp, Homo sapiens
atttattatgagagaatttattataatgactgcgatggtagtttataacttataaactctaccatatttgggaaattcacagttacaaacatttacctatgaagggggagtgagtagtcattccttcattttttacaaataagctgagtcgtggagaatttaagtgatgtgtgtagaaactcacagtaagtaaggcgtagtcttcatcactcttgtagtactgcattatctctttgtaaagttttcagggtttctgttttattaatggttattaattttatttatttatttatttatttatttttgagatggagtctgtcaccaggctgaagtgcagtggtgctatcttggctcactgcagcctctgcctcctgggttcaagtgattctcctgcctcagcctaccgagtaactgggactacaggtgcatgccaccacacccagctaatttttttgtatttttagtagagacagggtttcaccatgttggtcaggatggtatcgatttcttgaccttgtgatctgcccacctcagcctcccagagtgctggggattacaggcgtgagccacggcgcccagccaaaattgtccaagtcagtcgtagtttgagacgaggtctcgctggttgtgcaggctgtaagtgcaagggacaaaaatcagcaacagcaaaacattacctcccagcgctcatgaccttacgatcagcaacacgaaagaagagaaggagaacgacgaccgggaggccgcttgagtgaacagaggacccgaaacaaggcgcgatcacacaacacacccaaagctaacacaaaaacacggtaaacgaacaagcacaaatacacacaaaaaccaaaccaaaagagaacagacaacacacaaaaaaagaaacggaaaccaaaacac

SEQ ID NO: 109445 - DNA, 548 bp, Homo sapiens
cacaggttcttcatgaccctcctctcctcctcacccttggcagtattcttactagaccacaagtgcctgggggatcccaggacccgcccccttccaccgtcactcccagcctgagcctgtcacagctctgtccacagtgctgctggtttgtcacttcccagtggctttgaggaagtgccacccccccacccagggcccacccgagaaagtctccagcagtgaggtcccctgggccagttcggtgggccaagtcctgcactctgtgcccacaccgagccctcctcggggctggcagctcctgccgtgctgggcacttgacgggcaccccttgctgcatccccagcaacttggaaatgcagagtccaaaacgcctgaagccagggcctggagcctctgctggagcaggctggcatcccaaggggaatgtccccaaggggacatgcaggcagacaccctcaggagcacagtgacccaaggtcagtgtggggagatcgaggaggggctagaaggaggaggacccaggtcccaccgaggatggaggcaggtgt

SEQ ID NO: 109446 - DNA, 274 bp, Homo sapiens
ggcccaggccagcagatgctggaatccagagagaattgctgtttgagtaaggccacctggctgaggcagtgaccttcagcagagggacacagcctacctgtggcaacgcataagccagaacaggaaaaaacatctcaacctcacttccctcctgcccaccagtctcccgggagggcagccctccagtcaaccctaacggaaaccagagcgaaagcgagactagagatgctttatgcatcagcctcatggagcataaagtgagggttacggcaag

SEQ ID NO: 109447 - DNA, 378 bp, Homo sapiens
ctttcttgtactgtattaatttttgaacacttacttgaagtatatttgtaaaacaaattccttggagtagaattgctgttttaaaaatatttacattttaaattgtagtaatgtttgtcaggtttgtcatcttgttctccaaaaacagtgcagtatttcctgttgtagtaccataaagtttttgtagttctaaagtgaaaaaagtatgttaaaggaaaaattgtcactgttttagcttttaatttaggagattgtattggctttagaatttacaaactgttattggtagatgtttttattatcttgccaaagtctttgcagagatttggggcgtccattcagcagtgtttcctgagtcgttgtttttggtcaatgctg

SEQ ID NO: 109448 - DNA, 247 bp, Homo sapiens
gaaaaacagagccagcatggtggctcatgcctgtagtcccagtgctttgggaggtcaaagtgggaggatcgcttgagcccaggagtttgagaccaccctgggcaacgtagtgagaccctgcttcttacaaaaaactcagacaaacaaacaaaaagacaaaaaatagttgtagttgtgcacaactgtagtcccagctactcaggaggcagaggcaggaagattgtttgagcccaggaattttcaggct

SEQ ID NO: 109449 - DNA, 669 bp, Homo sapiens
acttgaccccaaattgaagaaaaaaatgttcttctagaatacataacaatctgttcttcacatatgtttggagccagaattttctctacctctatgatccaattaatttgaagctgagaaatttctttaaactaatgctggaatgggagtgtcaccatgttcccaacagaagtaaatgtaaaccatctattaaggaacctaccctaaatcccaggcttcaacaaaatccctgcaaaatgtataaaaatatatatgctcacaaaaataaaatacgaaagtaaataagatactaagagtgagcagaaaccactgaaagaagagtaaaactctcaaatactgtagatattagaattattgtatatagaatataatggttatgtaataaatacccttaaaataagagtgtcaatactacatttaataaatgatttactacatacagccattatggaaaacaatacagagcttcctcaaaaaactaaaaacagaactgccatatgacccagcaatcccactgctgggcatatatccaaaagaaaggaaatcagtatgtcagtgagatatctgtactaccatggttattgtagcactattcgcaatagccaaaatatggaatcaacctgagtgtccaccaatagatgagtagatttttttaatgtggtatatata

SEQ ID NO: 109450 - DNA, 488 bp, Homo sapiens
gttttggagtatatatattgtatgccatgaactatatttttctgcttatggctttgcctcatttaattgccatagcacttacatggggcaggtattcattttcctgcttagcaaataaggaaactgaatttcagagatgtcaggtaacctgcctacttcacacactaggagttttgatgtttaattttgaactaagatctatctggcttgaaagctctttgcattaaacaaccttgaacaatatacttggaacgtaggtgtgtttttggcacagaacatggcatgtgtgtgagggattgaacacagacttgcccagattcaaacttaccaatcttctgtttcatgtgcccagaagaaacagcctgtttctcagcctcaaacccaaacttctagttgtcttgattggttcagcctgactgtccaactctgatttatagctgtgattgggggagctgagattacacagtgtaggcaggcagaagggcccc

SEQ ID NO: 109451 - DNA, 299 bp, Homo sapiens
gttgttgagtgttcatgcgtcactgcagttaatcctcacatctctatgaggtggatgatattattgtcttagcttagagatgagcgctctggagacatgtttgttctttgctccaggcctctcagctttaagtacagagccaggatccaaaccttgatctgctttacaataaagtcgaagaacttaatctgaatgaatgctccactgccttatttttttaaatccagaaataaaagtagaacactacattgcctgggcattccaaagctcataaaacgtaataagattttggaaaaaag

SEQ ID NO: 109452 - DNA, 420 bp, Homo sapiens
ctagccctactcaaaagtatggaacggctatattaaattcagataaatcaggttttttggtttatttatttatttatttatttttcgagacagggtctctggcacccaggctggggtgcagtggtgtgatcacagcaacctgtgcctcccgaactcaagcaatcctcccacctcatctgggactacaggcgtgtgctaccatgcctggctaatttttgtatttattttttgtagagacagggtctctccatgttgctcagctggtcttgagaactcctgggctcaagtgatccacccatcttgtcttcctgagatgaatcacgaggtcaggagattgagaccatcctggctagcatggtgaaaccccgtctctactaaaaatataaaaaattagccaggcgtgttggtgggcacctgtag

SEQ ID NO: 109453 - DNA, 677 bp, Homo sapiens
taaggaggctttgtatgtgcaccccgcgtcatctgttgcctggggtgatgctctagcctcctgacattgtcatactgctgcacttttccagtctgtttccatttatgtctgaggttgcaattttttgaattttggaaatcagaccttggcgatgaccttgagcagtaggataggatataaataactcccacgtgcctagcgttccagtgaaggaacactaggcataaatgtgttaatgaagtaacgtaacacaagttaagtaaggtcatatcattccaaataagagctgacgtctctgtagtggccctcaaagactatccccttccttgtgcacccagctcccacttcagagcctttgcatgtactgttccctctgtctccctactctttccccaaacagaatgttgctgggtccctgcttccttcagctccctcttcacatgtcaacttattggtgaggtcttctctggccaccccttttaaaaataacaatcttgtccttcctggaaacttttttttttttctttctccaacactgttatcaccatctagcaaaaataaattacataatgttttattcatttatatttacatgtttttattatatggtgattctcattagaaagtaaaccttggaaggccatgtttgtgtgtttttatctctgctgtatctccag

SEQ ID NO: 109454 - DNA, 241 bp, Homo sapiens
taagaatgcacgtgtttcttatctactgagactatgctactcggttgaaaagaaaacgaatgcagactgtaataattccaacaagaatgacccttttctttagtagaaaaagacaagaactctttttttttttttttttttttttttttttttttttttttttttcaaagggggcccccccaaaaccccaccactagaaatgcaaaaaaagaaaaaaacacgggggtgaaggggggagaag

SEQ ID NO: 109455 - DNA, 312 bp, Homo sapiens
attttatattacctatttcaaaagattagtcagattaaagaaatattttatatttatactttatattgaagttgtccataattatgtattaacacatggttgtttttctagtggtttgtttaatatgtcctttatggtagtaggctaaggatggtgaatgactagcagatagttgttttgtacctatttaacatataaactatttgtgcctatttctgtaaataaagtttattataaaagtgattctaagtaactcgtcacattgggaaaattatttttattttattaaaatgacttaaaatattgtaattg

SEQ ID NO: 109456 - DNA, 459 bp, Homo sapiens
tatgggggtggtgcattaagcgtccatgccctccaggcacaccaccctcccaacattttgatgttaatccagggctctccaaactccattgttaaggtttttgaggtttccttagggaggcatgattgataaaataattggccatgggtgattaactcatcttcagcccctctcccctctgcagaggttgcagttagggctgaacgttccctctaatcatgccttgctgtttctggtgaccagcccccatcctgaagctactaggggcctccagccacaagctatgtcattagcatacaaaagacaccagttgagatttcaaggctttcaggaactatatgccaggaaccagggacaaagaccaaatatttatttttattatatcccatacatataaaagttacttgtaaattatatgtatatacacattaataatctcatgtatattacaagagatta

SEQ ID NO: 109457 - DNA, 2175 bp, Homo sapiens
cttcaagtctttttatttataagaacagtggagaaagttatcaagcaccagatcctggtaatggctcaatacaaaggccttatcaggacacagttgcagagaacaaagatgcattggaaaaaactcaaacatatttaaaagtacattctaatttggtaattccagatgtagaattagaaacatatattccgtattcaacccccacactgacaccttcagatacattccaaacagttgaaacgctgacatgtttgtctttggaaagaaacaggctaactgattattatgaaccattactcaagaacaattccactgcttattcaacaaggggaaatagaatagaaatttcttacgaaaatttacaggtcacaaatattactagaaagggaagcatgttaccagtgagctgtaagttaccgaatatgggtacttaccagagttacctttcctcatctatgccagctggttgtgttttgccagtaggtggtaattttgagatcttgttacattactatcttctcaattatgccaaaaaatgccatcaatcagaagaaaccatggttagtatgataatagctaatgcacttttaggcattcccaaagtcctttataaatctaaaacaggaaagtacagctttccacatacatatataagagctgtccatgcactgcaaaccaatcaacccttggtaagcagtcagacaggtttggaatcagtaatgggtaaataccagctactaacttcagttcttcagtgtttgacaaaaatattaaccattgacatggtaatcactgttaagagacaccctcagaaagttcacaatcaagattcagaagatgaactataacatcagaagtttttaattaaccaaacttttcatctaactcaagccaagtaaagcagtcatgtgaccactggttctaaagtcagttcagtctacttaggaaaatagcgtaactttaaaagtctttagaagaagcacactaaggtcaccagaccagatacaaatattaaattactttatggaacaaatctagaggggaagccaagatttggctaagtgtgtctgttttttccctattttatgcctctgtgtctcagctctgtgttagcctatgtgtttaggggagggtttttctttatagctcctttttactctcctgtatctttttcactccagccctccttcatcgttacatgtttagttcatagaatcatttaatctctgatttgggtgggcttattctaattgtttttaatattgaatacattatttgcattaattttccctactcatactttgtaaagctgagtaaaaggctcaaattatttttttcaaaaagcataaaattaaattagcagtgagtaaaaggctcaaattttttttcaaaaagcataaaattaatttttacttttatgtggtcattggtttactgccacttcatttggaaaacttggatagattttcacctttgatatacctttgaatatatgttacctgaaatataactgtgcattgttaactctttcatttctgtagtaaaaggttaatactagaaaggatatgcaattaatactttgattttctcctgaccccaagagcttgtaaggatatgtcatgtatttactggtttttcttgtatctggtgcatagccagagttccacagtaacaaataatttgacaatttttatttctaatgtttatttctgttttatttttaatttttatttctaatttatttcatttacaaatgttcatattttaaaaacttgtcaatgtaaataatatgatgcatcttatcatggacaaggacagtgttttctacctttatcagttctctgtaatacccaaaacagtgctgtatttactccaagtattcagaagtgcttgttgaataaaacagtgttatctttaattcattcctttaaatacatgtttccagtttacttattcaacagattcttacttgggattgactgaagaaaaaaaactttaattatagttgaataagtgttgactaatgtattttaaaaactataatatcaaaattttttatattaaatgtaattctgattttttaaacatttatgctatatgatgcattattttgtttctgtgaatatggagagaataaattagctcttttgctgaattcatggatgaatgaacttt

SEQ ID NO: 109458 - DNA, 1929 bp, Homo sapiens
cttcaagtctttttatttataagaacagtggagaaagttatcaagcaccagatcctggtaatggctcaatacaaaggccttatcaggacacagttgcagagaacaaagatgcattggaaaaaactcaaacatatttaaaagtacattctaatttggtaattccagatgtagaattagaaacatatattccgtattcaacccccacactgacaccttcagatacattccaaacagttgaaacgctgacatgtttgtctttggaaagaaacaggctaactgattattatgaaccattactcaagaacaattccactgcttattcaacaaggggaaatagaatagaaatttcttacgaaaatttacaggtcacaaatattactagaaagggaagcatgttaccagtgagctgtaagttaccgaatatgggtacttaccagagttacctttcctcatctatgccagctggttgtgttttgccagtaggtggtaattttgagatcttgttacattactatcttctcaattatgccaaaaaatgccatcaatcagaagaaaccatggttagtatgataatagctaatgcacttttaggcattcccaaagtcctttataaatctaaaacaggaaagtacagctttccacatacatatataagagctgtccatgcactgcaaaccaatcaacccttggtaagcagtcagacaggtttggaatcagtaatgggtaaataccagctactaacttcagttcttcagtgtttgacaaaaatattaaccattgacatggtaatcactgttaagagacaccctcagaaagttcacaatcaagattcagaagatgaactataacatcagaagtttttaattaaccaaacttttcatctaactcaagccaagtaaagcagtcatgtgaccactggttctaaagtcagttcagtctacttaggaaaatagcgtaactttaaaagtctttagaagaagcacactaaggtcaccagaccagatacaaatattaaattactttatggaacaaatctagaggggaagccaagatttggctaagtgtgtctgttttttccctattttatgcctctgtgtctcagctctgtgttagcctatgtgtttaggggagggtttttctttatagctcctttttactctcctgtatctttttcactccagccctccttcatcgttacatgtttagttcatagaatcatttaatctctgatttgggtgggcttattctaattgtttttaatattgaatacattatttgcattaattttccctactcatactttgtaaagctgagtaaaaggctcaaattatttttttcaaaaagcataaaattaaattagcagtgagtaaaaggctcaaattttttttcaaaaagcataaaattaatttttacttttatgtggtcattggtttactgccacttcatttggaaaacttggatagattttcacctttgatatacctttgaatatatgttacctgaaatataactgtgcattgttaactctttcatttctgtagtaaaaggttaatactagaaaggatatgcaattaatactttgattttctcctgaccccaagagcttgtaaggatatgtcatgtatttactggtttttcttgtatctggtgcatagccagagttccacagtaacaaataatttgacaatttttatttctaatgtttatttctgttttatttttaatttttatttctaatttatttcatttacaaatgttcatattttaaaaacttgtcaatgtaaataatatgatgcatcttatcatggacaaggacagtgttttctacctttatcagttctctgtaatacccaaaacagtgctgtatttactccaagtattcagaagtgcttgttgaataaaacagtgttatctttaattcattccttt

SEQ ID NO: 109459 - DNA, 2035 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagataaaaaaaaaatga

SEQ ID NO: 109460 - DNA, 3209 bp, Homo sapiens
  misc_feature (2985)..(2985): n is a, c, g, or t
tttttttaaggtccagtgacttttcacatgaaagaaatgcattctggacttccattaggatacgagaatcattacaatccattccatattgcttaatgagcatcataaacttcttacaatgagggtaaggtttctcatgatcctctgaagctgtttcagagggccgagttaagtcatcaggttcatctctaaatgagtttgctttttgacctttttcttttcatttgacattttctttgcaggcctagcatactctttgttctccttcctaggaaatcgctgatggtaagtttttccactctttctttgttgaattaatttatcatcatcgtcagcagatgtactatcatatacgtttttttgatactttttttttttaactttcgtgcttctttctagcttcttcaacctgtggctgtttattttcactttcaagcttttcctgttcttcctctgatgtcacttgtacttcttgttctgctttggatgtttgttcgttcttcctttctattgctttcttcacaacagaatctttcatttccatggtaggctttagggaaggatgtttttcaggaggcccttctccctttccatttactatatattttttccttttttatatgaaggtccaagtaaagactttgaaacactctcagggatacactgcttggtagtaaaagtcaagtcttcatcatctggtttaggccatgagtcaacacacagtttttttttaaatactgaatgcagatgcttcagaactcccagaatcttttgcacttgctcctcctgttttcaaacttgcattcttcttggatgcttcttctgggttgtcattttgaagaccattttcaagtatcttttttttttaatgttgcaaaatttgttgtgagtgcttgtcagaccaccagaaatagcataatctgcagtctgttcatacatactcttgagtaaagacaatattttgttgaagaagaatgctaactatacctgacaagccataatgtacaacaggcatgagagctgttcttttcaacctatcaacagcatgtacatttgcttgtttcttcactaaaattccaccttttgctgtgttttgcaaactatagcaagtaaaagtggtgtgtttgcatccttgttcagcacttcagtatccttgttcagcacttcagtattcacatggtgtgagggcagtttttctgccagtagtgtattctcattatacacagcatagtgtagtgcattgttgctatagacatccataagatctgggttggtgccacattctagcagaatgatgacacaaatctcttcttggcaatgtacagccttcatcaaaggcatcctgtttcatttgtcaccaatgtcagtctggcactttcagttcacctggagagtgaccacttccacatggccattggcacaggccaaatgtaaagcagtcgtgttcatccacagatgaaggaatacagaaactccaggatatttgcacaatggaatactcttcagccatcaaactttaggacatcaccccacttccagcaacgtggagagagacctgttcatccgcagatgaagggataaagaaactgtagtatatatacacaaatggaatactcttcatccagaaaaatgtaatgaaattacatcatttgcagccacactgttgaacctagaggacatcatggtaaatgacctgtcctgtccacccacagctgaagggataaagaaaccaccatacagatacactatggaatatgcttcagccataaagctttgggaaatcctgtcatccacagccatgtggagaaacccaagaaacccagaggatattaggtccaaggaaatgagcctggtagaggaagtcccacaccttttaatctcaggcatggagattccaaaaactttatctcctgtccatctacagatgaagggatcaagaaactgtaatgtatatgcacaaagaatactctttggccatcaaaataactaaaccatgtcatttggagcaacaaagccactgcggcctccatttgggccaagctctgactgcaatgatgcctctgccccgacccgggcctcgctgtgactgacaatgccgctgcatcttttcagcagtcattgatgaggaagtatctacatcctccttcccactaccagattttgcttggagaaaagcagtttcctgaaataattctgtgacgagcttcttccacattaggacaaaaatgctggtaacttttaaaaattcctacagaaacctcctgcttccctctccagccatatcccaggcaagcccccagcacaccaccctgccccagaacccatttcccatacccatccaccactcctgacctccaggccttggctcaggctggccttctgctcaaaggctctcctttggagtcgcctggctaagcacagctgtgcctcacccccgcaaaatctagtagtcatcttgaatttcttcctttccctcactatcattcattcattcaacaaaaatcttgtcatgtgcccgctgtgttccagcttttgttctaaatcctgggagacagtgtaattaagacacacaagtcctactcttgtacaacttgcatttgagcttggggcagcagggaaaggaggacaataaacaaaaccagataaatgctatgaaagaaaaaagataaaaccagtagactgtgatagtgaattaggggtgaggggagcagagtactattttaaatcagctgagcagggagaactcactaaggaggagacatttaacaagaaggaaccaccctggcaaaaacggggactaagccaagggcacatacggtgacatttttgccgtttgtagtaggaggggtcaaccaagtgatatgaggggaagggagcattcctctcagagggaaccacaagtgcagaggccctaaggtaagaagcagcttgatatttgaggaatggcagtgccttccttgggccatgcctgtgtgtgatgtaacngtcacaaacacttcttcacccaggttttacagcagaagggaactggtactccgacaagttccaaatgaggcagaagaatgtccgtatctctcctcttgtttgttcccttcgtcagtttgtttacccccccacccccacacccatctacctctagctccctaacctttctcctgccaccccccataaaggcccctaattaaataaaatatattttggaggagacc

SEQ ID NO: 109461 - DNA, 892 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactca

SEQ ID NO: 109462 - DNA, 1193 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatc

SEQ ID NO: 109463 - DNA, 3036 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcagatgaaggaatacagaaactccaggatatttgcacaatggaatactcttcagccatcaaactttaggacatcaccccacttccagcaacgtggagagagacctgttcatccacagatgaagggatacagaaactgtagtattcattcacaatggaatacccttcagctgtgcacatatactgaaatcatatcacctggagccacacagttgaacctgttcatcccttgatgaagggatgacaaaactgaaatatatatccagaatggaatacccttccacgacagaagtggatgaaatcctgtcatttgcagccatgtggagaaacctgttcatccgcagatgaagggataaagaaactgtagtatatatacacaaatggaatactcttcatccagaaaaatgtaatgaaattacatcatttgcagccacactgttgaacctagaggacatcatggtaaatgacctgtcctgtccacccacagctgaagggataaagaaaccaccatacagatacactatggaatatgcttcagccataaagctttgggaaatcctgtcatccacagccatgtggagaaacccaagaaacccagaggatattaggtccaaggaaatgagcctggtagaggaagtcccacaccttttaatctcaggcatggagattccaaaaactttatctcctgtccatctacagatgaagggatcaagaaactgtaatgtatatgcacaaagaatactctttggccatcaaaataactaaaccatgtcatttggagcaacaaagccactgcggcctccatttgggccaagctctgactgcaatgatgcctctgccccgacccgggcctcgctgtgactgacaatgccgctgcatcttttcagcagtcattgatgaggaagtatctacatcctccttcccactaccagattttgcttggagaaaagcagtttcctgaaataattctgtgacgagcttcttccacattaggacaaaaatgctggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagataaaaaaaaaatga

SEQ ID NO: 109464 - DNA, 4182 bp, Homo sapiens
tttttttaaggtccagtgacttttcacatgaaagaaatgcattctggacttccattaggatacgagaatcattacaatccattccatattgcttaatgagcatcataaacttcttacaatgagggtaaggtttctcatgatcctctgaagctgtttcagagggccgagttaagtcatcaggttcatctctaaatgagtttgctttttgacctttttcttttcatttgacattttctttgcaggcctagcatactctttgttctccttcctaggaaatcgctgatggtaagtttttccactctttctttgttgaattaatttatcatcatcgtcagcagatgtactatcatatacgtttttttgatactttttttttttaactttcgtgcttctttctagcttcttcaacctgtggctgtttattttcactttcaagcttttcctgttcttcctctgatgtcacttgtacttcttgttctgctttggatgtttgttcgttcttcctttctattgctttcttcacaacagaatctttcatttccatggtaggctttagggaaggatgtttttcaggaggcccttctccctttccatttactatatattttttccttttttatatgaaggtccaagtaaagactttgaaacactctcagggatacactgcttggtagtaaaagtcaagtcttcatcatctggtttaggccatgagtcaacacacagtttttttttaaatactgaatgcagatgcttcagaactcccagaatcttttgcacttgctcctcctgttttcaaacttgcattcttcttggatgcttcttctgggttgtcattttgaagaccattttcaagtatcttttttttttaatgttgcaaaatttgttgtgagtgcttgtcagaccaccagaaatagcataatctgcagtctgttcatacatactcttgagtaaagacaatattttgttgaagaagaatgctaactatacctgacaagccataatgtacaacaggcatgagagctgttcttttcaacctatcaacagcatgtacatttgcttgtttcttcactaaaattccaccttttgctgtgttttgcaaactatagcaagtaaaagtggtgtgtttgcatccttgttcagcacttcagtatccttgttcagcacttcagtattcacatggtgtgagggcagtttttctgccagtagtgtattctcattatacacagcatagtgtagtgcattgttgctatagacatccataagatctgggttggtgccacattctagcagaatgatgacacaaatctcttcttggcaatgtacagccttcatcaaaggcatcctgtttcatttgtcaccaatgtcagtctggcactttcagttcacctggagagtgaccacttccacatggccattggcacaggccaaatgtaaagcagtcgtgttcatccacagatgaaggaatacagaaactccaggatatttgcacaatggaatactcttcagccatcaaactttaggacatcaccccacttccagcaacgtggagagagacctgttcatccacagatgaagggatacagaaactgtagtattcattcacaatggaatacccttcagctgtgcacatatactgaaatcatatcacctggagccacacagttgaacctgttcatcccttgatgaagggatgacaaaactgaaatatatatccagaatggaatacccttccacgacagaagtggatgaaatcctgtcatttgcagccatgtggagaaacctgttcatccgcagatgaagggataaagaaactgtagtatatatacacaaatggaatactcttcatccagaaaaatgtaatgaaattacatcatttgcagccacactgttgaacctagaggacatcatggtaaatgacctgtcctgtccacccacagctgaagggataaagaaaccaccatacagatacactatggaatatgcttcagccataaagctttgggaaatcctgtcatccacagccatgtggagaaacccaagaaacccagaggatattaggtccaaggaaatgagcctggtagaggaagtcccacaccttttaatctcaggcatggagattccaaaaactttatctcctgtccatctacagatgaagggatcaagaaactgtaatgtatatgcacaaagaatactctttggccatcaaaataactaaaccatgtcatttggagcaacaaagccactgcggcctccatttgggccaagctctgactgcaatgatgcctctgccccgacccgggcctcgctgtgactgacaatgccgctgcatcttttcagcagtcattgatgaggaagtatctacatcctccttcccactaccagattttgcttggagaaaagcagtttcctgaaataattctgtgacgagcttcttccacattaggacaaaaatgctggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagataaaaaaaaaatga

SEQ ID NO: 109465 - DNA, 2316 bp, Homo sapiens
tttagtagagatgaggttccaccatgttggccaggctggtctcaaactcctgagctcaagtgatctgtctgcctcagcctcccaaagtgctgggattacaggtgtgcacctggctgatttttttttttaaacgtaaaaaggatttttgtttcctgtctctattttagaatcatgtcacttgtaatattttaggtcatctaatccaatcaacaaaggtatattgactctgtatttgaagcatttgtcatgactgttgcattatcagttattcaggagtttctgtatggggcacaaattagctcttcttagcagcagactaatctgaagaaatgactcccacgaataagaatctgtctgaatacgtagggcttttattaggtcacatctcactaagtgctgatcagttttgattcagttggagtagagcacataggttctttggagatgattgttttagagagttgcatgaaagaatagaaatcaatgagccagcagccttctcagagcaatgaaaactgccttttcagattagttttgatcatctcagctccattaccctttattctttcttttgtttgtttgtgtatcctgaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagataaaaaaaaaatga

SEQ ID NO: 109466 - DNA, 2194 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcagatgaaggaatacagaaactccaggatatttgcacaatggaatactcttcagccatcaaactttaggacatcaccccacttccagcaacgtggagagagacctgttcatccacagatgaagggatacagaaactgtagtattcattcacaatggaatacccttcagctgtgcacatatactgaaatcatatcacctggagccacacagttgaacctgttcatcccttgatgaagggatgacaaaactgaaatatatatccagaatggaatacccttccacgacagaagtggatgaaatcctgtcatttgcagccatgtggagaaacctgttcatccgcagatgaagggataaagaaactgtagtatatatacacaaatggaatactcttcatccagaaaaatgtaatgaaattacatcatttgcagccacactgttgaacctagaggacatcatggtaaatgacctgtcctgtccacccacagctgaagggataaagaaaccaccatacagatacactatggaatatgcttcagccataaagctttgggaaatcctgtcatccacagccatgtggagaaacccaagaaacccagaggatattaggtccaaggaaatgagcctggtagaggaagtcccacaccttttaatctcaggcatggagattccaaaaactttatctcctgtccatctacagatgaagggatcaagaaactgtaatgtatatgcacaaagaatactctttggccatcaaaataactaaaccatgtcatttggagcaacaaagccactgcggcctccatttgggccaagctctgactgcaatgatgcctctgccccgacccgggcctcgctgtgactgacaatgccgctgcatcttttcagcagtcattgatgaggaagtatctacatcctccttcccactaccagattttgcttggagaaaagcagtttcctgaaataattctgtgacgagcttcttccacattaggacaaaaatgctggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatc

SEQ ID NO: 109467 - DNA, 1969 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctgggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagataaaaaaaaaatga

SEQ ID NO: 109468 - DNA, 1888 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcaggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagatttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagataaaaaaaaaatga

SEQ ID NO: 109469 - DNA, 2194 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcagttaaaaaacaatgtctaacccatgcaatgaacttttgactgtatgtctcatttccaaaggaatgagatcattgaggtggacccagagaaactgaattcagagaaaaacttccattattgagaacccaaacgctgattgccagacaaaaggatgagaggaaatgctggacctccagtttcttgttaattgctctgtttttccataagggactctgccttaagctcattttcattgacttatcatttctgggtttgctctggtgtgaaaattctcatttaattttttttcttcagattctgcctctagtttagaaaagaaaaagtctaatttacaattcatgtcagacaattttgatggcacactgtggcctgtcagagatttctttagcattctatttttttaaattatttttaatttttgtttttttaattgaaacagctttattgaaataaggtttacatactacagaatttatctcttttaacatacagttcaaagatttttagtaaatttattgagtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactcaagaagggagacctgtttgtttcatttctcatctgtttgggagatgattttagagcactagaaaggcactggggagattctcagcttaaaacatccagcagtttgaagtatgattaggtacatcagggctgcattgtcaatgttctctttaagtcttttaacatttatagcaattttttttttcccggagagtttaggttgcaagttttgggtttcttgtttgtttttgttttgcttcctgctttaattctttaattttcagtcattactggtattgaaaaataaaatatctttaaaacatctcctcttcagaaataggtccctcttcattgcccatcaccatcttccactctcctattattttgccactactcagtaaaggaaggtaggaagagacaaacgcctaagtgcaggtgtggggagggatttcacaagtggttattaacggccagttcagcaagaagtgttgagtgtgtacaaaggggagggctggaagtgttaactccagacccgttggctgcttgagttgtttcttatattctaaagcagcagtccctaacctttttggcaccagggaccagttttgtggaacacagtttttccatggacggggtggtggtggaggatgaaacttccacctcagatcatcaggcattagagtctcataaggagcacgcaacctagatccctcgcatgcgcagttcacaatacggttctaagggctttagagtaagcagctttttcacctgtgggcctctggtgagaaattctgtaaattgtgataatcaggctggattttaatgctgcttttccagtacaatgttagagtttgggttcattaaaattaggcaaactcccattgggttagggcttctctcattccattttgtggctaaccttactgtgtttcagcccttgctgaaaattcttctgatatgtgttgcccttcctcacagccctttggccattgggagtttggctgtccctcagagccatccggtcaagcagatggtctgttctatctcacagaaaagtcttttcttccatgagttctgtctgaactgaacatgtaaaaagtatgggaaacagatgaatccctattaaacatgaagttttgattgtatttaagataaaaaaaaaatga

SEQ ID NO: 109470 - DNA, 1893 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcagatgaaggaatacagaaactccaggatatttgcacaatggaatactcttcagccatcaaactttaggacatcaccccacttccagcaacgtggagagagacctgttcatccacagatgaagggatacagaaactgtagtattcattcacaatggaatacccttcagctgtgcacatatactgaaatcatatcacctggagccacacagttgaacctgttcatcccttgatgaagggatgacaaaactgaaatatatatccagaatggaatacccttccacgacagaagtggatgaaatcctgtcatttgcagccatgtggagaaacctgttcatccgcagatgaagggataaagaaactgtagtatatatacacaaatggaatactcttcatccagaaaaatgtaatgaaattacatcatttgcagccacactgttgaacctagaggacatcatggtaaatgacctgtcctgtccacccacagctgaagggataaagaaaccaccatacagatacactatggaatatgcttcagccataaagctttgggaaatcctgtcatccacagccatgtggagaaacccaagaaacccagaggatattaggtccaaggaaatgagcctggtagaggaagtcccacaccttttaatctcaggcatggagattccaaaaactttatctcctgtccatctacagatgaagggatcaagaaactgtaatgtatatgcacaaagaatactctttggccatcaaaataactaaaccatgtcatttggagcaacaaagccactgcggcctccatttgggccaagctctgactgcaatgatgcctctgccccgacccgggcctcgctgtgactgacaatgccgctgcatcttttcagcagtcattgatgaggaagtatctacatcctccttcccactaccagattttgcttggagaaaagcagtttcctgaaataattctgtgacgagcttcttccacattaggacaaaaatgctggaagcggctcagccccagggcagcacatcagagacaccatggaacacagccattcctctgccgtcgtgctgggaccagtctttcctgaccaatatcaccttcttgaaggttcttctctggttggtcctgctgggactgtttgtggaactggaatttggcctggcatattttgtcctgtccttgttctattggatgtacgtcgggacacgaggccctgaagagaagaaagagggagagaagagcgcctactctgtgttcaatccaggctgtgaagccatccagggcaccctgactgcagagcagttggagcgcgagttacagttgagacccctggcagggagataggacccagctgtgctgtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactca

SEQ ID NO: 109471 - DNA, 1051 bp, Homo sapiens
acgcaggcgcagcggcggccggcgcgggccgagcggaggcaactgctgtgcggcctgcgggcgcgcgctcccttatcggccaacggacgcgaggcgcgcgccatggaacagcggttagctgagtttcgggcggcgcggaaacgggcgggtctggcggcccaaccccctgctgccagtcagggcgcacaaaccccaggagagaaggcggaagcagcagcgactctaaaggcagccccaggctggctaaagcggttcctggtatggaaacctaggcccgcgagtgcccgggcccagcccggcctagttcagttaaaaaacaatgtctaacccatgcaatgaacttttgactgtatgtctcatttccaaaggaatgagatcattgaggtggacccagagaaactgaattcagagaaaaacttccattattgagaacccaaacgctgattgccagacaaaaggatgagaggaaatgctggacctccagtttcttgttaattgctctgtttttccataagggactctgccttaagctcattttcattgacttatcatttctgggtttgctctggtgtgaaaattctcatttaattttttttcttcagattctgcctctagtttagaaaagaaaaagtctaatttacaattcatgtcagacaattttgatggcacactgtggcctgtcagagatttctttagcattctatttttttaaattatttttaatttttgtttttttaattgaaacagctttattgaaataaggtttacatactacagaatttatctcttttaacatacagttcaaagatttttagtaaatttattgagtcatgcagctaacctctgatgtggtcttcctcaccattggctatggatttgatttcaggtgtataggactaagggcagcttgcgggttagctctgtgactgcatagtttttctaccttctttccctgatcttttgctgccatttgatctttgatagttttggtgaaactctctaaaatacattcactgtgggtccgacgcaatttataaaaattatgtactca

SEQ ID NO: 109472 - DNA, 558 bp, Homo sapiens
tgtgcataattttaaaatgtttttttgaaaaacattttaagtttaaattggattcccaaccttatttttaaaaagtcacagaaacaagaatagagagaaatctagccatgttttaactggtagaatttcggacggatatttgttttgtattttccaattttttcaagtgtgtctatgttattatgttcagaaaaaaaaacgttaaaaaataaggctattgcaatggtttggtgaatgatgatacatgtgttgctttgtttgtaagtctaggatagtctagcctgagagcctgctattgagtagaacttgtagaatgatggatcatgaaccaaattgaacaaagagaagcttcactctgggaaatctgtacctaccaactaggagtcaagataggaaaatataagggtataagatagggaaattactaagaaacagtccaggaattttagtccagacaccttgcatactactgagtaaaaggtgagtctttaaagaatttgcaccagttggatacagtctgaactaaagcagttgctaagactgaaaatgtgcaagcca

SEQ ID NO: 109473 - DNA, 600 bp, Homo sapiens
ggaggaatggcgttttctatgaagaagccctttggagtatgtgaggtgctgactttacatgtagagagatgaaatgactgtgatggttgtgttacatggggccggtggttgttttaaacagatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109474 - DNA, 321 bp, Homo sapiens
  misc_feature (29)..(29): n is a, c, g, or t
  misc_feature (32)..(32): n is a, c, g, or t
gttttattggtagtccgcttatttttttnttntagaaaaaaacttaagctactagcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109475 - DNA, 324 bp, Homo sapiens
ccgttagtgttcccccgcccctttttctttatttttatattttattaatttcaatagccaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109476 - DNA, 331 bp, Homo sapiens
tgatttttttcgcccccaccttttgttttttttatgtagaagagaaaacctcgaagactcacgaacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109477 - DNA, 329 bp, Homo sapiens
cggattgttgcccggatggcacggccgctttgcaaggaggaaggaagggttacagactacaaacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109478 - DNA, 328 bp, Homo sapiens
  misc_feature (44)..(44): n is a, c, g, or t
  misc_feature (53)..(53): n is a, c, g, or t
acaaataacttaacaacaatccaaaaacaaaaaaaaaccttaanagtaacaancagcccttccaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109479 - DNA, 326 bp, Homo sapiens
ttttttatggtcgcgtttcttttcgttataaacaggataaaagatctacagactacacagcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109480 - DNA, 325 bp, Homo sapiens
  misc_feature (43)..(43): n is a, c, g, or t
cgcgtatcctcccccccaatattttttatatattttgggggancttcaagactcacgagcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109481 - DNA, 313 bp, Homo sapiens
cccgaaacattaacgcatcaaccacaagcagaaagaacaaaaacctacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109482 - DNA, 762 bp, Homo sapiens
  misc_feature (635)..(636): n is a, c, g, or t
  misc_feature (643)..(644): n is a, c, g, or t
  misc_feature (670)..(670): n is a, c, g, or t
  misc_feature (686)..(686): n is a, c, g, or t
  misc_feature (713)..(714): n is a, c, g, or t
  misc_feature (729)..(730): n is a, c, g, or t
  misc_feature (740)..(740): n is a, c, g, or t
  misc_feature (742)..(742): n is a, c, g, or t
  misc_feature (748)..(749): n is a, c, g, or t
  misc_feature (751)..(751): n is a, c, g, or t
  misc_feature (754)..(754): n is a, c, g, or t
aactgttactcccatcagtttgtgctttcaaactgatggctgacttctctgaatttgtgtagcgcacaacgaatggtgatgctgtgctccgggggctgcagtgcaccctttttaaagggaccctgcaatctcattgtttaatttgactctttagtgcttcagtcacatcagcacttgcagaggggttgttcttttcctttttcttctttctctctttttctcttctctctgtccttctccccacccccatccctcaattcaggcagtttggggtgggaaaaacttgagcactggttccgacagagctcatctcatataagaaggtttggaagagctgcagtgatcgacagcatcgaccgttctgtaactccttaaatttaagagctgcaggtaggattggccgtgttttgtaaagaaattaagacaaatgcaccctggtaaatagagtggcagcatgttgttgcagtgcctctgaaagacaaggtcttggtttgtttgaaaatttgagataaatttggaagcagttaactcatttgatagaagaagtacttgattcttctgagaattgttcagatttgtatcttgccattctaatattttttcttttaaaaatgtattgggggggaatttgcttnnatatttnnatagttggttattgggatttttgtgnacttcttctttaagtngcagtagtgtggtctttaggatttttnnaggagatacatgtgnngtgccattcntntatganncnggntatgccca

SEQ ID NO: 109483 - DNA, 2954 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109484 - DNA, 2929 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcatgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109485 - DNA, 2677 bp, Homo sapiens
tcctggtaccggtccggacagttttttggatgacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109486 - DNA, 2482 bp, Homo sapiens
ccgttagaggatcccgagagggtgcccaggagtacggagattcagcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109487 - DNA, 2511 bp, Homo sapiens
attcggctcctcttggcattggagttctggatttacccatgactaagattcctttgaaactctgacccagtgcagcattgcaaagaatcgatttctgagatgagacaatgagatgtggtttgcattttgtaaagatggaggaaacctctaacactgaccctgtatgggagatgactcaattatccacgccttgggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109488 - DNA, 1576 bp, Homo sapiens
tattataacctgggaccgtcgaacaggacaagcaatgatcagaatgattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109489 - DNA, 1281 bp, Homo sapiens
tgctgatctcgaggttccgggtcggctatctgtccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109490 - DNA, 2825 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109491 - DNA, 2779 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaagtaagttccttcttcctgagttgtggaattcctttttccccacttccaccaaaagctttttcttttcctgtacctaacagctttaagaattctagttacagtaactatccagactgagttttccagagtggttccctttcagataccttggcctggcttttctgtgagtgcatacatccccatcagattattgtctgaattcctaattgagaaaatacag

SEQ ID NO: 109492 - DNA, 2129 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatttcttgggaactacgagaatgacagaacgtagaaagccttggagg

SEQ ID NO: 109493 - DNA, 1991 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtccttctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109494 - DNA, 310 bp, Homo sapiens
atgtctttttggtattttgttaatcgtcattttttccgctttcacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109495 - DNA, 327 bp, Homo sapiens
  misc_feature (40)..(40): n is a, c, g, or t
gttggtctgcaccccgcggacgatcccagaggggacgccntgtcattctaatactcacgaacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109496 - DNA, 327 bp, Homo sapiens
cgttcgcatttctagttcgtcacattacccctctctatcccagcccaggtatcctccttagcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109497 - DNA, 658 bp, Homo sapiens
aaaaaaaaaaaaaaaaaaaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgaggtagcttgaatgcaaaagataaactactgttaataaaaacatgaagtcaaagaa

SEQ ID NO: 109498 - DNA, 400 bp, Homo sapiens
gcccaccctccctccatctgtggttggccccaaaggcttggttctttttctttactctgtttttctctctatgtagatcaggcacaacctctcagaagtgcttcttgccaccatgaacatcttgttcacacagtttaagaggctcaaggggacaagtccatcctcgtcatccaggccccagcgagtcatcgaggaccgcgactctctctgtaagatcccagcattcgcgagaaacattgctaagcaccacctttctggtttggaatccgttgcgctcttatgagaccacatgacccaaaactgctctttctcctcagtacctggcagctggataaatctcgtgttaggaggctcccagaggaaatcaaatattaaagggattgctgctcttctcaagctt

SEQ ID NO: 109499 - DNA, 336 bp, Homo sapiens
cggcttcttttccgagaacgcgccgtcccccagacacggaaagactttaagctaaccagactagccctgccaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109500 - DNA, 312 bp, Homo sapiens
atggaaaacaaagagacaagacaggaaagggtagtcaaggcacctacaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109501 - DNA, 2730 bp, Homo sapiens
aaaaaaaaaaaaaaaaaaaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109502 - DNA, 2708 bp, Homo sapiens
aactgttactcccatcagtttgtgctttcaaactgatggctgacttctctgaatttgtgtagcgcacaacgaatggtgatgctgtgctccgggggctgcagtgcaccctttttaaagggaccctgcaatctcattgtttaatttgactctttagtgcttcagtcacatcagcacttgcagaggggttgttcttttcctttttcttctttctctctttttctcttctctctgtccttctccccacccccatccctcaattcaggcagtttggggtgggaaaaacttgagcactggttccgacagagctcatctcatataagaaggtttggaagagctgcagtgatcgacagcatcgaccgttctgtaactccttaaatttaagagctgcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109503 - DNA, 2520 bp, Homo sapiens
aaaaaaaaaaaaaaaaaaaggaagcgggggagagcggcgcgagaagcggcggccgcgtcctcaagccggcacctgagcggcggagtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109504 - DNA, 2667 bp, Homo sapiens
aaaaaaaaaaaaaaaaaaaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109505 - DNA, 3149 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgtatttcttttcaacattcttttattttcttttttttttcctttgaaattttgtttacatttttatttgtgtaatgggaaataccgtcactagctcttgggccagggaatgagaggctatgtagatattcattatttggttaaattgaccttaattaattaaaaatctacccaaaatgagccaggaaacaaagcctt

SEQ ID NO: 109506 - DNA, 2721 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatatcattgagcgcttgaagctggtgcccctgaatcaggaaagtgtggaagagagagtggctgccttcagaaatttcagtgatgaaatcaggcacaacctctcagaagtgcttcttgccaccatgaacatcttgttcacacagtttaagaggctcaaggggacaagtccatcctcgtcatccaggccccagcgagtcatcgaggaccgcgactcttgtacaccactggccactgaatacgtaatcatg

SEQ ID NO: 109507 - DNA, 2619 bp, Homo sapiens
gcccccggccaggctaggcgtcctgctgctggatgaaggggttggggatggcctccatgccgtcctgcgggcagattagcaccacggacgtgccccggcacaccacgaggcccagctgccgggtgtcctccgtgagcttgtactggtcgtcagggtctcgcatgtactcaatggtgccgtccagcacaaggttgaggagtgggtcgaagcccttcaggattccactggctctcgtgccgaattcggcacgagggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtcagttctcctcgggtctcggggacttgacatatcccacatctcccagcgattggagagtctgagtgcagccaccacctttgagcctcttgagcctgtgaaggacactgacattcagggcttcctgaagaatgagaaggacaatgccctgctgtctgccatcgaagagtcccggaagaggaccttcggcatggctgaggagtaccatcgggagtcaatgttggttgagtgggagcaagtgaaacagcgaattctgcacacactgctggcatcaggagaagacgcccttgactttactcaagaaagcgagccaagctacatcagtgatgtgggaccccctggtcgaagctctctggataacatcgagatggcctatgcgcggcaaatttatatctataatgagaaaattgtaaatggacacctgcagcctaacctggtggacctttgtgcttccgtcgcagagctggatgataagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagagttataagaattacacccttgtgactgtctttggaaatttgcatcaggcccagctgggcggggtgcctgggacttaccaattggttcgaagtttcctgaacattaaactgccagctcccttgcctggactacaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaagttgaaccaagtgtgttttgacgacgatggcaccagctccccacaagacaggctcactctctcacagttccagaagcagttgttggaagactatggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctcctcagccacgagcctggtgaccctccttgcttgcggcggctgaacttcgtgcggctcctcatgctgtacacccggaagtttgagtccacggacccaagggaggccctccagtacttctatttcctcagggatgagaaagatagtcaaggagaaaacatgtttctgcgctgtgtgagtgagcttgtgattgaaagccgagagttcgatatgattcttgggaaactagagaatgacggaagtagaaagcctggagtcatagataagtttactagtgacacaaagcctattatcaacaaagttgcttctgtggcagaaaataaaggactgtttgaagaggcagcaaagctgtatgaccttgccaagaatgctgacaaggtactggagctgatgaacaaactgctgagccctgtcgtcccccagatcagtgccccgcaatccaacaaggagaggctgaagaacatggcactctccattgccgaacggtatagggctcaaggaataagcgcaaataaatttgtggactccacgttctatcttcttttggacttgatcaccttttttgacgagtatcatagtggtcatattgatagagcttttgatgtaagtttcaggaaaggtgtttgaagtgcaggttaatgtacaccctcgaaaattcaaaacacttcatggaatttacttaaaacaaaggagctgttgccagtatgtttgttgtataaagaaagacaagtacaatcctgggactta

SEQ ID NO: 109508 - DNA, 329 bp, Homo sapiens
  misc_feature (42)..(42): n is a, c, g, or t
  misc_feature (47)..(47): n is a, c, g, or t
cacacgcagcagcacagcgaaagggtccgcaaccaacacacnaaacngtttcaaggtgacgagcaactccgaagtcaagcccgcactctgattacctttgctggaatgataccataccgaacgtctggggacaccaatgcgaggctggtgcagatggaggtcctcatgaattaagtgccatgctttgtgggagtctgggtcggcacactgtcagtacatcaggcacatgggcccactaggctggggtttctggttttgtttctgttgtgttttgttttggtttctgtattatgtatttttgtcaacgccaataaatttctttgatttgt

SEQ ID NO: 109509 - DNA, 504 bp, Homo sapiens
aaaaaaaaaaaaaaaaaaaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtagtgaacgaaaaataacaatacaggaccttcggcatggctgaggagtaccatcgggagtcaatgttggttgagtgggagcaagtgaaacagcgaattctgcacacactgctggcatcaggagaagacgcccttgactttactcaagaaagcgaggtagcttgaatgcaaaagataaactactgttaataaaaacatgaagtcaaagaa

SEQ ID NO: 109510 - DNA, 996 bp, Homo sapiens
ctgccttggcctcccaaagtgtgggataatacacgtgagccactgtcccaggcttatcattatttttgaaaactagcctcaggctgtcttaatgactaggtccagctgacctaaattgagtccacagccttgcccatttcagtttatctccaagccataatgtgtggataattactgaagtagtcatgtgggtcattgaggaatatcaggagctttcgctacagcagtggccttcaacccttagtgcgctgctagtgaaatgcaaatattgggactctgttccctgagaatcttggggtcagggaagtaaccctagagtttgcatttctaataacctctggggattctaaagcacgtggttcttagcactgaaaaacactaaaaaatataacaggtgtttgagggaggaggaggaaagaggaattcattcttggtatttatcaggcactgtcaggggccatagctccccaagaacaggaaccatgcttactcttctgtatccctagcatcagcatggttgctagcactgagtaagaatgtaagacattttgagtggataaattcattaaaacaaattgataaatgacctatacatagggtgctatcaaatacaactctcttcaggtactttgatgttataaaaaggattgcacatgtagacagtctttattaggaataaacaagaaacatgttaagtgacaacagtagcagagataaaacagcacatgttcaaaattaggaaagccaatgaggcaggaggattgcttgagctcaggtgttcaaggctgccatgagttatgatcatgccactgcactccagcctgattacagtgagaccttgtctcttaaaaaaagaagcagtagcagccaagagactaagatcaattaagccaaactggttatcacggattttttttttaacatcaaagtcacacggatgcataatttgaaaagtcagaatgtactgtacaattgcctgactcagtcctgggtcca

SEQ ID NO: 109511 - DNA, 143 bp, Homo sapiens
cagagcataaaagcaagacacggtcagacctattccgtgtgagaatgtttcagactggttcacatgattactatagacgtctataattattttgtttaaacttcatgtttcataaattgtagatatatgtttgttagggaaaa

SEQ ID NO: 109512 - DNA, 337 bp, Homo sapiens
tatgttgtaatccactgtggtgtctcatcaaacggtatgcaaataacattccaaaatcgaaatgtgaacctaatctttgcttgtgttctgttacgttgtgatgagctctatgtatataatatttaaaataaatggagatctttatttttatatcccaaatgttagacaattacaatgtatatttcttgggtgtatactttgtcattcttgtgcattgcaatttacctgttctatggaataggttttatttagtgaatattgaggtttttcaaagtcatttcagttatttgggtacctattatagtgaaaagtcacgggactgaaagtcaagaattgt

SEQ ID NO: 109513 - DNA, 514 bp, Homo sapiens
aaaatattttacatgcaaatacttggattatacacaaccatttagtaacacattaatagcgaatataaaaaaaacaagggctatattctaatgtggtacacagatttgtttgtttgcctctataagttgaatcaacatgtaaaatttagaagactcgtgaagaaatgtggacttcaggcatatcctaaaaaatcaaatctggtgtcccctgagtttctatcattgtttggtctgctgtgcagaagttgcccctttatagaaggcggcatgtattctccagtttgctactgtgcccaccttagtacttcccttactcaggcaaccttcctttgtccttgtaagtatctgagtttacaactcctatgttatagtatattttgataaaaatttcaaggtttttaagtcagcatgtatttgtttataatatatagtctatagagtatataaatccctcagttatggagttgaattttagagtttagaagtttttaactcttttctttatatataccac

SEQ ID NO: 109514 - DNA, 215 bp, Homo sapiens
tgtactaccaagttcagaaagttcagctcatcaaaatcttggatgagtgtgatatctgaagagttttcaaatggagatctggggctagatctctgtgttcatgttaagggaccttgaaacaagtgaaggccagagaccaagtgttatgtattgcccattctgggtatatactaggtactcagatactttttaattgaataaaaatttaaaaagtt

SEQ ID NO: 109515 - DNA, 735 bp, Homo sapiens
caggctggagtgcagtgacatgatcttggctcactgcaacctccacctcctgggttcaagcgattctcatgcctcagcctcccaggcagctgggactacaggtgcccaccaccatctctggctaatttttgtatatttagtagagatggggtttcaccacgttgtccatgctcatctcgaactcctggcttcaagtgatccacttgtcacgaactcccaaagtgctgggattacaggtgagccactgcacctggcctaggtactattcttttatcatttactaccataaaatatatacaagtctatcatatgttaaaatttatgaaaacttaagctcactacatggcgccattcacagttgagaaatgtaaaccaatgtaaagccatattaaatcataactgcataaaatactgttctataatatagccatctgttgctactatgagctcaagtgttgctagtatccacttaaaacaccatgtgtgacacttatcactgttttatagcctattactggttatgttttgggggactcaaaagttttatgtgaatttttgattggcagtcattgttcaggggtcaccttagtgaattaactgcaaagtgagcaattttgtatccgtgacacaggtcaagagaacagaacagtgccagtactccagaagcttcctcatgaccccttgtggtcactatcctgtcccacttccctctccaaaaggtaatcattatattgg

SEQ ID NO: 109516 - DNA, 320 bp, Homo sapiens
ggtatatttgcatgatcacagaaataacaagtctaggatgaatagcactaaaatgtctaagatatatataatattgaccaagatttctctctttttttcctctctctcacctctcgtgttcttctcctcccaccacatactcatcaacacaaccatcaatcaatgacactaacagaatcacttctttatcagaacttaaaccacaaaagaggtatcctgtaattccataatctgttctgctcattaaatcctgggttttaagtgagtaaataaattatttgatgagaagtatttcgacctgaagtaatactatttaagaa

SEQ ID NO: 109517 - DNA, 364 bp, Homo sapiens
gatcaccgcagccttgacctctggggctcagctcaggtgatcctcccatctcagcctccccagtagctgggactacaggtacatgtcaccatgctcgggtaatttttgtattttttgtagagatggggttttgccatgttgcccaggttggtcttgaactcctggagttaagcaatctgcgtgcctcagcctccagagtgctggggttacaggcatgagccaccacactcagctggttgttttttgtttaagacaggaggaggttgctctgtcgcacaggatgaaatgcagtggcacaatcatggatctgggctgcatccttgatctcctgggctttaagcaatccttccacctcagcctgggt

SEQ ID NO: 109518 - DNA, 778 bp, Homo sapiens
gggaagaagactgaaacatatgctcacttctctccagattgcataaatgccttcgccttttacttagcactgctccggaactgtatggaagttgctattatttgaatgtttaaggtaccatttattgtaacgggtttttggagttatgaaaaagcacctttgcaggccaatcagtgcacactggcagaaaggataaattacaaagctgaaagaaagaccctctttgagtgtattggaagcttttatgtataagtctaataatagaatgagaaagctgaatgagaaagttagataagggatatgatggagactgcagggcagaaccaccattaaatcatgataattctataggtcaaaaggttttctttgtctctgatgcctgcagagttataactgaatcctactagaagggaaatgcagggttcagtcccttctcatctttcttcttggagagatgaatcctgattcacaggcctaaatcttctattaggggaagctttgtgggacccagagtagccaccctaacttttccgcaattgagctacccctgacaaaaaaagtaggcgtgaagacccagaatgcttagtttaatcagttttaaatgaaaagtgaaactttgttttctataacataaatatatgtccttcaaaacatgtggtaagctgtgtttcatttttagaaggtatatacttttaaataaatgagtaattcaggaattggagaacattacgctaagtgaagtatgtcaggcaaagaaagacaaatactgcatgatctc

SEQ ID NO: 109519 - DNA, 1470 bp, Homo sapiens
cacctctgctgctgagcagccccccagccccctgggccgagagcctgggggtccgcctggcagcttcctgacctcccgtcggccccgcttacctctcacggtgccctttccacccacctgggctgaggaccctgggccagcctatggagatgcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcactcctgctccctctcccttttcactgttgctttctatgtatagctccctagacctttcacttttttaaaaacgcgttttgtgtaaaaaagaaaaaaaaaaaaaaaaggaggggcgggccccgaccgatacaactccccggggcgggcagcctcactatatacactacccgccccgttgtataatggtgagcagagggcggaccatcataggacgagcatataatgaaacccacgagactgacacgcggcgcttattcacaacgacggaggagcgcaggggagacgaagacactgagatcacgaccgcgttgagctaggggcaagaacccccaaccatctgcgcgtgacgtaaccaaacatcgaggccacacacagtccaccaccaagaagaacacagccggcagcgcggaacacataaccaacaaacacacggacggactaaaacgtcagcgacaacaacaccacacactgggtggcgcgcagaaagaagcaaagattgcactacacacagtcgaacgactcgaaagaaacaaacatactcagcagcggaacggagtgaactaacctcccgcccacacgaaaccgagacacccacgtcatcctagcgagcacacaccagagacgacgagcggagacatgacgaatcgagagaagagagaagagaacaacagacgacgacagagcacgcgacgcaaacagcaggccgacaaacacacgccacaggcgatgcagcacagagtcacgcacaaacacagcagcgagcaacgtcacaacacgaccaaacactgaccacgcacgacacaagaaacggagagccgaaccacgagaggcccgacaacgagcatagatcgaaccgacagacgcaacagaagagcgacagacaccatgagcgagacgaccaacaggcaccacgacccgaaggaccgaaccgcaccacaaactgaaccgcgagaatcacaaaaaca

SEQ ID NO: 109520 - DNA, 4715 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctac

SEQ ID NO: 109521 - DNA, 4316 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcacctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctac

SEQ ID NO: 109522 - DNA, 4033 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaa

SEQ ID NO: 109523 - DNA, 4988 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaaaaaaaaaaaaaaaaaaaaaaaaaaaaaaaaaaaaaaaaaaaaaaaaaaaaaaaaaaaaaaaaaaaaaagaaaaaaaaaagaaaaaaaaaaaaaaaaggaggggcgggccccgaccgatacaactccccggggcgggcagcctcactatatacactacccgccccgttgtataatggtgagcagagggcggaccatcataggacgagcatataatgaaacccacgagactgacacgcggcgcttattcacaacgacggaggagcgcaggggagacgaagacactgagatcacgaccgcgttgagctaggggcaagaacccccaaccatctgcgcgtgacgtaaccaaacatcgaggccacacacagtccaccaccaagaagaacacagccggcagcgcggaacacataaccaacaaacacacggacggactaaaacgtcagcgacaacaacaccacacactgggtggcgcgcagaaagaagcaaagattgcactacacacagtcgaacgactcgaaagaaacaaacatactcagcagcggaacggagtgaactaacctcccgcccacacgaaaccgagacacccacgtcatcctagcgagcacacaccagagacgacgagcggagacatgacgaatcgagagaagagagaagagaacaacagacgacgacagagcacgcgacgcaaacagcaggccgacaaacacacgccacaggcgatgcagcacagagtcacgcacaaacacagcagcgagcaacgtcacaacacgaccaaacactgaccacgcacgacacaagaaacggagagccgaaccacgagaggcccgacaacgagcatagatcgaaccgacagacgcaacagaagagcgacagacaccatgagcgagacgaccaacaggcaccacgacccgaaggaccgaaccgcaccacaaactgaaccgcgagaatcacaaaaaca

SEQ ID NO: 109524 - DNA, 2539 bp, Homo sapiens
tcacccatcgtagagtatctattggtcgcgtgtgcgtttacaaaggcaggtaactgatatcatggcaacaatgagtctcttcactgttccatgaaccgactgttgttgatcctgatagtttggcttatctgtcgagtacatcgctatggtgagtccaatcactcacggtcagcccatgttgaaactgcgttgattgacgtcgtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctac

SEQ ID NO: 109525 - DNA, 3189 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggtaggctgcccctgggggagggagggagaccacctgagtggaccttggtcacccggagccttggaacaggatagggtttggtggaagctgggaggtgtcgcctcagtggctgcccttgggtgtggtggggctcaggctaaaggctgacaccctgagctttgtagcctgcgagacctgggttcaaatcccaactctgccacttaccagcttagtgacctcagggaaggacttacctgctccttacctcaatttcctcactcataaaagcgggttgataacaaacctaccttacagat

SEQ ID NO: 109526 - DNA, 1958 bp, Homo sapiens
gcaaaatgacctcctttgactccatgtgtcacatctaggtgatgcaagaagtgggttcccagggtcttgggcagccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctac

SEQ ID NO: 109527 - DNA, 2157 bp, Homo sapiens
gttgggtaggatttgcttctctgtgccctctactgtctcagattctatgtatctgccagatggcaggggtacctggaagccagtagcccttacctggcaccagtgacttctgagcacagaggcaggggtctctgtgagaccctgccatgaccccatggtgagtggaggtggctgtccatgggaaacgcctgacttctgggtccctcttcccccgcctcctgggctggctctgtccacactgagtagcagcaggtgtgcccagggatgctggcaaggctatgcttccgcctctcctcacagcactggccactccctctctctgttcccccatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccagttcctgggttgaacgaccacatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctac

SEQ ID NO: 109528 - DNA, 1422 bp, Homo sapiens
cacctctgctgctgagcagccccccagccccctgggccgagagcctgggggtccgcctggcagcttcctgacctcccgtcggccccgcttacctctcacggtgccctttccacccacctgggctgaggaccctgggccagcctatggagatgcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctac

SEQ ID NO: 109529 - DNA, 485 bp, Homo sapiens
gcaccgtcgggggacggttggataacaggatgatactggagggattcttgtggttggagatcaggtgttttccaggatccccgactcggagatggagactttccggaaagggaatggggcagggtcctagggcaggtcctagctccgcccgtcggggctcttaagagttttgacgttgtttaagggggtctgagtgaggccggaagattcccatcctagggatagagatgtccggggactgggctggggcggcggttagaggccgctgggcgcccagcgtgggtgcatccgctagccagggcgcgcgacaagcttccagcagctgcagccgtccgccctcagggcccagacgaacggtttcgctcgtggcactcggcgctcggcgctcggcactcggcaggccaacctgggcgcgccctgaggggcggggcggagcgggtttggcggcggcggcagcggcactcggcactcggcgctcagctgct

SEQ ID NO: 109530 - DNA, 4694 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccaatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaacaccctggggcaggcggccagcgtgtgtttttctgtcaagtggacaggctggcattggctggcagccggggctgggatcggggcctcctctgtccagagcgccatggaggccctgggttttccagttggccgccaagccgaccagacgcagctggggatgagcccaagttcccagctgttggctctttaggccatggctgggagggggtctctggctggctggcaaagcggctccagtgagcagatgaaccagggttctgggcagcctgtctgggaagggagccaggatcaagaagcagttgaggctagaggagcttatcaaaggcaggagctaccagcgagggtgtcagggacccgttgggagcatttgggtgggggccagtggggttgtagagagctggaactcacctgcttttaatacatgtgacttctagtgagacacatgcacccctgacccaaggaacatgcggggaaaagaggagccactggctcctttgcgatgttatttattttctcgctctgcaaatgtttattgaacatttctgagattttaagagattttgttggctgctccttcttgtttattgcatgtggtttttcagctcatcgtttttactaaacggtcaagtgctggagagtgggaacgacctcatggcgtgtggacagaaggggccacctctac

SEQ ID NO: 109531 - DNA, 4012 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacaaatttgaacgccgacaagcccgccctccagatgcctccgcagcccggggaggcgaggacaccaatgacctacagcagaagctggaggaggtgcggcaacccccaccccgagtccggccagtcccctccctggtgccccggcccccccagacatcacttgtcaagttcgtgggcaacatctacaccctcaaatgcaggttctgtgaggtggaattccagggccccctctccatccaggaagagtgggtgcggcacttacagcggcacatcctggagatgaacttctccaaagcggaccccccacctgaggagtcccaggccccgcaggcacagacagcggcggcagaggctccctaacacaaaagcattccagatcccctctcgtgccacctctgtctcctcttcttcctcctctgtgtcctcgtccctcttcctctttctttccgtttccaaaggagcaagccaaaacctcaaaccggcgccccttgggggccgggcacactacagccagggcgccgggagccagctagctgcccttcccccagcccgaggactctggggccacagggtgtcttccttcagcccatgcccacctggtccagcaggggcagcagccaggtctctgatggcagccggtctggtcacaggggaggacagcactcccccgtctagcagccaggcagggcgatgtctgccatccgtggccatttgcaaagaccccaaagacccctgttctggttccctctctcccccatgaatatcctctcacacacatgtacatgcgaacacacacaacacgcacctcgtgagacccgggacctgccccggacccccaatcatgccacggtgcttgctcaggggaagccacgctccctctgtggggcctgctggggcctgggagccccccactgagcccacaatgccacggaaatccttgttggctgcccccgagaggggccttcccagctgggaagagctcagagctgacagctgcctcctgccatgtcaaggccccccaaagagcctcaggggctctggggccctggagggtggggttggggggtgggactctcctcccccactcctgctccctctcccttttcactgttgctttctatgtatagctccctagacctttcacttttttaaaaacgcgttttgtgtagagaataaggaacgtggatctttttattttgcaatcctgggccagctagaagccaggagctgattgaccttttaacttttttcagtggccacattttggttatcgatgtacctagaagtatgtaaattagattaaatttctcttctggaaa

SEQ ID NO: 109532 - DNA, 2838 bp, Homo sapiens
agcaggcggtgattgaaatgtgttgccggccttgtggggttccctaggtctgcggaacggcaccgtcgggggacggttggataacaggatgatactggagggattcttgtggttggagatcaggcctgggttctgaggaaaacgcaatggtggccatggacttgggctctccctcgctccctaagaagagcctgcctgtccctggggccctggagcaggtggccagtcggctgagcagcaaagtggctgcagaggttcctcatggcagcaaacaggagctgcaggacctcaaggcccagagcctgaccacctgcgaggtctgcggtgcctgctttgagacccgaaagggcctgtccagccacgcgcgctcccacctgcggcagctgggagtggcagagtcggaaagcagcggcgcacccatcgacctcctctacgagcttgtgaagcagaagggtctgcctgacgcccaccttgggctgcccccaggcctggctaagaagtccagctcactgaaggaggtggtcgccggggccccccggcccggcttgctcagcctggccaagcccttggatgcccctgctgtcaacaaagccatcaagtcgcctcccggcttctcggccaagggcctgggccacccgcccagctctccactcctcaaaaagacaccactggccctggcgggctcccctacccctaagaatcctgaggacaagagcccccagctgtccctgagcccccggccggcctccccaaaggcacagtggcctcagtctgaggatgaggggcccttgaacctcactttagatagtgacgggggcagagagctggactgccagctgtgcggtgcctggtttgagacccgcaagggcctgtctagccacgcccgtgcccacctgcgccacctgggcgtcagcgatccggacgccaagggatcccccatagacgtgctccacgggctcatcaggagggacggcgtccagatccgcctcccacccaggcgcggcgccctggcccacccggggcggccgcctcccacctccgcggccctctccttgcttccccccccaccgccggccaagaaggccaagctgaaggccgcgggtatggccagcccctgggggaagcaggacctctcggccgccgcagccgccggcattttctgggcctctgatgtggagccgtctcctctcaacctctcctcaggcccagagccagcacgagacatccgctgcgagttctgtggtgagttcttcgagaaccgcaagggcctctcgagccacgcgcgctcccatctgcggcaaatgggcgtgaccgagtggtacgtcaatggctcgcccatcgacacgctgcgggagatcctgaagagacggacccagtctcggcctggtggacctcccaacccaccagggccaagcccaaaagccctggccaagatgatgggcggcgcaggtcctggcagctcactggaagcccgcagcccctcggaccttcacatctcacccttggccaagaagttgccaccaccaccgggcagccccctgggccactcaccaactgcctctcctcctcctacggcccgaaagatgttcccaggcctggctgcaccctccttgcccaagaagctgaagcctgaacaaatacgggtggagatcaagcgggagatgctgccgggggcccttcatggggaactgcacccatctgagggtccctggggggcaccacgggaagacatgacacccctgaacctgtcgtcccgggcagagccggtgcgcgacatccgctgtgagttctgcggcgagttcttcgagaaccgcaagggcctgtcgagtcacgcgcgctcacacctgcggcagatgggtgtgaccgagtggtccgtcaatggttcgcccatcgacacactgcgagagatcctcaagaagaagtccaagccgtgcctcatcaagaaggagccaccggctggagacctggcccctgccctggctgaggacgggcctcccaccgtggcccctgggcccgtgcagtccccactgccgctgtcgcccctggctggccggccaggcaaaccaggtgcagggccggcccaggttcctcgtgagctcagcctgacgcccatcactggggccaagccctcagccactggctacctgggctcagtggcagccaagcggcccctgcaggaggaccgcctcctcccagcagaggtcaaggccaagacctacatccagactgaactgcccttcaaggcaaagacccttcatgagaagacctcccactcctccaccgaggcctgctgcgagctgtgtggcctttactttgaaaaccgcaaggccctggccagccacgcacgggcacacctgcggcagttcggcgtgaccgagtggtgcgtcaatggctcgcccatcgagacactgagcgagtggatcaaacaccggccccagaaggtgggcgcctaccgcagctacatccagggcggccgccccttcaccaagaagttccgcagtgccggccatggccgtgacagtgacaagcggccgtccctggggctggcacccgggggcctggccgtggtcggccgcagtgccggaggggagccagggcccgaggctggccgggcagccgacggtggtgagcggcctctggcagccagcccgccaggcaccgtgaaggctgaggagcaccagcggcagaacatcaacagtgagtgcttggtggaggagggtcgggagcgcagcgggcacctgtcaggcccacccagccactccccaggcgctctgctgtggcccttaagtcctttctccagttgcttacccattcacccatccatcccccatcccaccc

SEQ ID NO: 109533 - DNA, 303 bp, Homo sapiens
ctctgggcccacacaacctgcaaatggatttgacttggcctgcactgagatttttttctaccatgcatcaatcactagcattgaaacatcagaagatgtgacacaaaagcctgctccctattctctaaacatcagaagagcggccaccagggcccacaatccttcgtggcaacaacaagcaaaaacagagaacagctgcagggtgggccaagcaagggctcccggggtcaccgcaggccccatctgccccctgctgtcactcacatggcctgcccagaccctagaggcatcagagttggagac

SEQ ID NO: 109534 - DNA, 132 bp, Homo sapiens
gcagctgcgacagtgggggctgaaaggaacatgcttgagttggaatgaataagtggggatttctgagcactgcgtcatcggtgcataagaatggggactgtggccagacacagtggctcacacctggaatcc

SEQ ID NO: 109535 - DNA, 292 bp, Homo sapiens
acactcggaacactggcaggatggacgaggggttgctgcccacctggcatgggtttctgctgagaacctggcggaggtggtgggacgcacgcttgtttgatagtgccttggtgcctcggtggccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgggtcctgcctagcccaggctctcc

SEQ ID NO: 109536 - DNA, 580 bp, Homo sapiens
tcaaaagtctatttttatctgtaagaatatacagtagattcatgtgttctattgttacattggattattcctcctactttcacatcagctgttttagaagtgacctttagcaaacattatgttttttattttcaaaaatagcattacagaaatcacattaatatacaacatatcttgaaggtgtacagaaaccaataaagccagtaatatataaagaataatgcaaatagttatgccacatggcaggcaatgactacccataacggccccttccttgttgattctcgatgactagaataaccagagagacaagacttgtatttttgtctaacaataatgccaaaaagtactaaattttcttgaaaaaaaaaagtgtttttgttttccttttccatactcctacattatctctcctccaaaattgaatagtagaggatgatctgcagcacttcctcaatttccccacactatccccgccccctaagccccacaaaacactggctggcaccagagccaagatgggtaggtagtttgttaagtgaaaaggaaaattaactggtttccccaagaaaagcaaaat

SEQ ID NO: 109537 - DNA, 586 bp, Homo sapiens
gctgggattacaggcatgcaccaccatgcctggctagttttgtatttttagtagaaatggggtttctccatgttgctcaggctggtttcgaactctcgacctcaggtgatctgcccacctcggcctcccaaagtactgggatttcaggcatgaaccactgcgcccggccagcaatagattttctaacataggctactaatcattcacactcctttaaggaggaaacttgaggcaaaatcaccccataaagattggaggacagaactgtataggcagtttccaaatgctgcatgaagatgacaaagtaggatgttcagattcctgagaatgggtgttttaaaggggagagtctggagccagggacatcagtcaggctgcttaccttaacagtcctgcacttggtgttagaggggttggagactgggctgaggcagccatgcaaatagaaggggatgtttcaggccattttgttgatccatacaactttctgcagttttttattcttcactcttacccctttattcaagttttatttttatttttaacagttttgtggaggtataattcacattgaacatatccatcg

SEQ ID NO: 109538 - DNA, 1360 bp, Homo sapiens
tgagcccgggcgggggtcggggctgcgcctgctccgccccccaggcggggtgtcctggcgcccgcgggaacctggggcgtcgctccctgcgcggcgtccgggtcgaggccgcagcactcggcgtccccgcgggactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaa

SEQ ID NO: 109539 - DNA, 1572 bp, Homo sapiens
tgagcccgggcgggggtcggggctgcgcctgctccgccccccaggcggggtgtcctggcgcccgcgggaacctggggcgtcgctccctgcgcggcgtccgggtcgaggccgcagcactcggcgtccccgcgggactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagtctgtggcccagacccaggcaagtggtaaatatttaccttcacgctggagccaagatcgctgcggggagtcccgtgaagcaccactgccctctaagaccttggaaggggaaacaccagaaggtgtgggtgctgagctccgctgcgtcagactgccaggacctgagtggaactcagtgctgaaacctgggttctcactgcagctggatagcagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaa

SEQ ID NO: 109540 - DNA, 1654 bp, Homo sapiens
tgagcccgggcgggggtcggggctgcgcctgctccgccccccaggcggggtgtcctggcgcccgcgggaacctggggcgtcgctccctgcgcggcgtccgggtcgaggccgcagcactcggcgtccccgcgggactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagtctgtggcccagacccaggcaagtggtaaatatttaccttcacgctggagccaagatcgctgcggggagtcccgtgaagcaccactgccctctaagaccttggaaggggaaacaccagaaggtgtgggtgctgagctccgctgcgtcagactgccaggacctgagtggaactcagtgctgaaacctgggttctcactgcagctggatagcagatcagcagctctagagggtggcggccttgcctggaacctccgcaacctccgcgcccaccacacaagggctgagaacagtaagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaa

SEQ ID NO: 109541 - DNA, 1848 bp, Homo sapiens
tgagcccgggcgggggtcggggctgcgcctgctccgccccccaggcggggtgtcctggcgcccgcgggaacctggggcgtcgctccctgcgcggcgtccgggtcgaggccgcagcactcggcgtccccgcgggactgaaaactggatatttggtccccatggactttctggtcaccctgtgaagtggacttaactttttcttgaatcatgtggaaggattctgaagtcaaaagtttttaagactctcaggcttactgtggatctggattctaaggcaacacttccttgaagaaacaagcttacagtctgtggcccagacccaggcaagtggtaaatatttaccttcacgctggagccaagatcgctgcggggagtcccgtgaagcaccactgccctctaagaccttggaaggggaaacaccagaaggtgtgggtgctgagctccgctgcgtcagactgccaggacctgagtggaactcagtgctgaaacctgggttctcactgcagctggatagcaggtggttacaaaattatatgtatttttagggttatttctaatttttctctaatagttattggcaattttcaaagtcctttaagaaacactgaaaactgctcaagaaaatggcagttctgcagggctcaggtagcagggcaggctgttgggacaggtttgacagactgtcctaatacaaggagcgccttttcccagatcagcagctctagagggtggcggccttgcctggaacctccgcaacctccgcgcccaccacacaagggctgagaacagtaagctctgcccggatggccctagtcttcgtgtacggcaccctgaagcggggtcagcccaaccacagggtcctgcgggacggcgcccacggctccgcagcctttcgggcgcgcggccgcacgctggagccctacccgttggtgatcgcgggggagcacaacatcccgtggctgctgcacctgcccggctcggggcgcctcgtggagggcgaggtctacgcggtagacgagcggatgctgcgctttctggatgacttcgagagttgcccggccctgtaccagcgcacggtgctgcgggtacagctgctggaggaccgggccccgggcgcagaggagccgccagcgcccaccgcggtgcagtgcttcgtgtacagcagggccaccttcccgccggagtgggcccagctcccgcaccatgacagctacgactccgaggggccgcacgggctgcgctacaacccccgggagaacagataagggggacgggcagggtgggcctaggtttgagagccctggggctccaagatgcgcccagcccatgctgggtgaaggcggaagccgaacagggccctttccaatgaatctgccggaaaggaaccaatctttcagtggcagctgattttacaaataatgttgagatacgaatagcaaggtgcttccctcccatctttctacctggtaagaaaaatttaggattttaactcccctaaatgacatttagagaactcgtgttatgcctaattcttcttcctcctcgtgttgtttctgctgttggctctgctttgagctcaagataataataaatatttaggatcagtgtaaagacttggtgttgccgctagattttagcagccctactatactgattctggcctgtaacccctgagaaagccgattttacacggctgggtagaatttgtagaaaagatccacagggcaagcatgctgtatatcagagtgcgtatagcaccattcttcctaattttcagatcaagcttcacagcaaatattaaagattatttaaatttgaagtcgatgttttgggaaatcagatataaaa

SEQ ID NO: 109542 - DNA, 3825 bp, Homo sapiens
tgtccaggtctccacacctctctcagcagttaatccctttatctattccttgggtcaaaacttttgaggtgggctagctatatagcagcgggggagagggtaaactggggcgcgcgggttggaggcgcttcagcaccgcggccagcgcccactgcagcccaacccactctctagagctcccggactcctagctctgagaatgcctgcggaatgatcgccccccagggcggctgccgccgctgccgctgctgctgttattgctactgctgctgccgccgcctctgcttccactcggctctgactggcaggcagaaagtgcaactgacgagggaaaggtctctgcagtgagtggagagcctacataaaagagagtaaagaggggcaaaaacccagatcagaatgcaggcgacgtccaaccttctcaacctcctgctgctgtctttgtttgccggattagatccttccaaggatggaagtaaaaaggcaggacctcgagcagtcaccttggatcccaaaatgaaagtgttatactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaattgatttaaaaaagagaaaagaagaagaaaaaaggcaacagaaaggagaagcataagcaatagtattttgggaagctataacacgcgacttgcctccctgttcacctttgtattctcagcacctagaatagttctggtacaaaataagttcacagtaaatggttgtcaaatgaataaattaattattatatctttaaatagtaactattgtttttaccctctaacatatttcagagaaatgcttagtgctacaagaaagtaaagtttgctttctaaggtatgattgactggagtaagaatcaattttcctcacaaaaccaggtacaaaataaaagagtcaactagccaaaagaccactttaccatggtcacccaatgtttagtttaagagccagaagcttttaacctccggtacaaattctgtcctaagttttggccgaaacaacctaagactcagcagtatccctttgccatagagatgcaaggctggattagattcaagcaccatcgaagccaaagacaccccaagccagtgatgtgctgtgggttgtttggaaatgtcgattagataaggctcatggtatgattcagagctccaaggacagttcttgttcaggtttcaactaatcaacatcggattatgcacacctcaacatctgaaatatgcagacatttgagacaaataccagaattgtgtcttcttgctttgtacaaatcatgcttcagtctggcaataagcatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatg

SEQ ID NO: 109543 - DNA, 3425 bp, Homo sapiens
atgagtcctccactgctgaagcttggcgctgtgcttagtaccatggcaatgatctcaaactggatgtcccaaactctcccatccttggtgggactgaacaccacgaggctgtcgactccggataccttaactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaattgatttaaaaaagagaaaagaagaagaaaaaaggcaacagaaaggagaagcataagcaatagtattttgggaagctataacacgcgacttgcctccctgttcacctttgtattctcagcacctagaatagttctggtacaaaataagttcacagtaaatggttgtcaaatgaataaattaattattatatctttaaatagtaactattgtttttaccctctaacatatttcagagaaatgcttagtgctacaagaaagtaaagtttgctttctaaggtatgattgactggagtaagaatcaattttcctcacaaaaccaggtacaaaataaaagagtcaactagccaaaagaccactttaccatggtcacccaatgtttagtttaagagccagaagcttttaacctccggtacaaattctgtcctaagttttggccgaaacaacctaagactcagcagtatccctttgccatagagatgcaaggctggattagattcaagcaccatcgaagccaaagacaccccaagccagtgatgtgctgtgggttgtttggaaatgtcgattagataaggctcatggtatgattcagagctccaaggacagttcttgttcaggtttcaactaatcaacatcggattatgcacacctcaacatctgaaatatgcagacatttgagacaaataccagaattgtgtcttcttgctttgtacaaatcatgcttcagtctggcaataagcatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatg

SEQ ID NO: 109544 - DNA, 2688 bp, Homo sapiens
atgagtcctccactgctgaagcttggcgctgtgcttagtaccatggcaatgatctcaaactggatgtcccaaactctcccatccttggtgggactgaacaccacgaggctgtcgactccggataccttaactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatg

SEQ ID NO: 109545 - DNA, 3764 bp, Homo sapiens
tgtccaggtctccacacctctctcagcagttaatccctttatctattccttgggtcaaaacttttgaggtgggctagctatatagcagcgggggagagggtaaactggggcgcgcgggttggaggcgcttcagcaccgcggccagcgcccactgcagcccaacccactctctagagctcccggactcctagctctgagaatgcctgcggaatgatcgccccccagggcggctgccgccgctgccgctgctgctgttattgctactgctgctgccgccgcctctgcttccactcggctctgactggcaggcagaaagtgcaactgacgagggaaaggtctctgcagtgagtggagagcctacataaaagagagtaaagaggggcaaaaacccagatcagaatgcaggcgacgtccaaccttctcaacctcctgctgctgtctttgtttgccggattagatccttccaagactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaattgatttaaaaaagagaaaagaagaagaaaaaaggcaacagaaaggagaagcataagcaatagtattttgggaagctataacacgcgacttgcctccctgttcacctttgtattctcagcacctagaatagttctggtacaaaataagttcacagtaaatggttgtcaaatgaataaattaattattatatctttaaatagtaactattgtttttaccctctaacatatttcagagaaatgcttagtgctacaagaaagtaaagtttgctttctaaggtatgattgactggagtaagaatcaattttcctcacaaaaccaggtacaaaataaaagagtcaactagccaaaagaccactttaccatggtcacccaatgtttagtttaagagccagaagcttttaacctccggtacaaattctgtcctaagttttggccgaaacaacctaagactcagcagtatccctttgccatagagatgcaaggctggattagattcaagcaccatcgaagccaaagacaccccaagccagtgatgtgctgtgggttgtttggaaatgtcgattagataaggctcatggtatgattcagagctccaaggacagttcttgttcaggtttcaactaatcaacatcggattatgcacacctcaacatctgaaatatgcagacatttgagacaaataccagaattgtgtcttcttgctttgtacaaatcatgcttcagtctggcaataagcatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatg

SEQ ID NO: 109546 - DNA, 3027 bp, Homo sapiens
tgtccaggtctccacacctctctcagcagttaatccctttatctattccttgggtcaaaacttttgaggtgggctagctatatagcagcgggggagagggtaaactggggcgcgcgggttggaggcgcttcagcaccgcggccagcgcccactgcagcccaacccactctctagagctcccggactcctagctctgagaatgcctgcggaatgatcgccccccagggcggctgccgccgctgccgctgctgctgttattgctactgctgctgccgccgcctctgcttccactcggctctgactggcaggcagaaagtgcaactgacgagggaaaggtctctgcagtgagtggagagcctacataaaagagagtaaagaggggcaaaaacccagatcagaatgcaggcgacgtccaaccttctcaacctcctgctgctgtctttgtttgccggattagatccttccaagactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatg

SEQ ID NO: 109547 - DNA, 3088 bp, Homo sapiens
tgtccaggtctccacacctctctcagcagttaatccctttatctattccttgggtcaaaacttttgaggtgggctagctatatagcagcgggggagagggtaaactggggcgcgcgggttggaggcgcttcagcaccgcggccagcgcccactgcagcccaacccactctctagagctcccggactcctagctctgagaatgcctgcggaatgatcgccccccagggcggctgccgccgctgccgctgctgctgttattgctactgctgctgccgccgcctctgcttccactcggctctgactggcaggcagaaagtgcaactgacgagggaaaggtctctgcagtgagtggagagcctacataaaagagagtaaagaggggcaaaaacccagatcagaatgcaggcgacgtccaaccttctcaacctcctgctgctgtctttgtttgccggattagatccttccaaggatggaagtaaaaaggcaggacctcgagcagtcaccttggatcccaaaatgaaagtgttatactcagattagtcctaaagaagggtggcaggtgtacagctcagctcaggatcctgatgggcggtgcatttgcacagttgttgctccagaacaaaacctgtgttcccgggatgccaaaagcaggcaacttcgccaactactggaaaaggttcagaacatgtcccagtctattgaagtcttaaacttgagaactcagagagatttccaatatgttttaaaaatggaaacccaaatgaaagggctgaaggcaaaatttcggcagattgaagatgatcgaaagacacttatgaccaagcattttcaggagttgaaagagaaaatggacgagctcctgcctttgatccccgtgctggaacagtacaaaacagatgctaagttaatcacccagttcaaggaggaaataaggaatctgtctgctgtcctcactggtattcaggaggaaattggtgcctatgactacgaggaactacaccaaagagtgctgagcttggaaacaagacttcgtgactgcatgaaaaagctaacatgtggcaaactgatgaaaatcacaggcccagttacagtcaagacatctggaacccgatttggtgcttggatgacagaccctttagcatctgagaaaaacaacagagtctggtacatggacagttatactaacaataaaattgttcgtgaatacaaatcaattgcagactttgtcagtggggctgaatcaaggacatacaaccttcctttcaagtgggcaggaactaaccatgttgtctacaatggctcactctattttaacaagtatcagagtaatatcatcatcaaatacagctttgatatggggagagtgcttgcccaacgaagcctggagtatgctggttttcataatgtttacccctacacatggggtggattctctgacatcgacctaatggctgatgaaatcgggctgtgggctgtgtatgcaactaaccagaatgcaggcaatattgtcatcagccaacttaaccaagataccttggaggtgatgaagagctggagcactggctaccccaagagaagtgcaggggaatctttcatgatctgtgggacactgtatgtcaccaactcccacttaactggagccaaggtgtattattcctattccaccaaaacctccacatatgagtacacagacattcccttccataaccaatactttcacatatccatgcttgactacaatgcaagagatcgagctctctatgcctggaacaatggccaccaggtgctgttcaatgtcacccttttccatatcatcaagacagaggatgacacataggcaaatgtgacatgttttcattgatttaaacagtgtgatttgtgataaactctataagaccccttccgtttttttcttcactattatttttcatcatttctccaaagcaaagcatttttattgtaaagttggtgtttcaaaaacatagctgagcttgtctaacttaccatgttggaaacacatcttaacttctaaatttacaaggcctatcatgtccttgtcatgaaaagcactaaaaaaaaaaagagtttaagtggctaaagtcatagttttgcaagagattaatgatctgccttatattagagtcagagactaatggtggcttaaatgcacgaatgtctttttttttaaaactgtcattttttactgtcttttgctccatatcaggaaatattttggtaggaattaggagaacaaaaagcacttttatcccatttatttctttaaaaaatgtaaggatttcatttatattgaaaaataatattaatcattttgctgttaacacaattctctgatgcggtgctgtacagtcatttttaaatctcttgctaacattttattggcagtatgtatttctaccattgtaaccaccattgtgctattgtatctcttcacttctgtgaaagtaatattttttataaaatacactgaaatttaacctcagtaattgagtccattttcaagtgtggtcaagaataatcttcttggcttacccctttacataagcattataaactaaaatgaaaaccaaaccagacacctgacatagagtctttattttaccccaagttttttgggccactgacattgaatgcaacaactgatttcatacaactgagttactctgttcactccactgaatgcaacccatatagtttcttgcacaaggtgcatctggattccaaatattggatttgagttgactctactcatttattatacactaaagaaattttgttcttcatagttaaatgtactagcatttaatttatattttacatacaacttgcaataatgaaattccttatgtcaggaccctgaaaataagcacatttgaaaactcttagaaaaaaaaaattctgtaatgtcctctagatttagattatgagccctgaggagttattggcaagatttgtgcaaaataaaatatggggagacttgggagttgtctttgtggtttcaaaagtgtaaataaccaattcagaaaacaaaatggaaaaacgaccccttgttaccttgattcactgtatg

SEQ ID NO: 109548 - DNA, 264 bp, Homo sapiens
tgattccatataaccagtgaaaaaatgacaaaagatttcaaatgaactttttttgtctttaagtagcttaagcaagttaatttgaaatattttgctcttttacgctataaatgtatttattttatgctacaactgaatttccatgggtctttagagtatatctaagagtcagtgagagtaaactatatatatacacacacatacacacacacatatgtattttattttttatttttttgagatggagtctcactctgtcaccca

SEQ ID NO: 109549 - DNA, 656 bp, Homo sapiens
aaaccccatctctactaaaaatacgataattagccaggtgtggtggcacatgcgtgtagtcccagctaattgagaggctgaggcaggagaattgcttgaatccaggaggtggaggttgcagtgagccaagatcgaaccactgcactctagtctgggtgacagaggagcaagactctgtctcaaaaaaaaaaattctataatttttatagaaataataaaaaactaaccttagcttactgtaaattttctagtttagaaacttatttaaaaacaatttttggactcttctagtaataacgtagcttaaaacacacattgcatagctgtacaaaaatattttccttatatccttattatataagcttttatctatttaaattttgaatttttaaactttttggtcaaaaaccaagacaaacacactagcctaggcctatgcagggtcaggatcaagacatccctagcaggtgacaggaatttttcaactccattataatctgtggggccaccatcatatatatattgtacattgaccgaaacatggttacatgactatataatttgcgtcaatactgctcagtgtgccatatttaaatttacatgactatattgtgatattcttttcaaaataaagtttatttgggagataaaaaatt

SEQ ID NO: 109550 - DNA, 480 bp, Homo sapiens
aggtgagtgagttctctcttagctcctaagaaagctggttgttaaaaagagcctggcacctccctgcaacccccacttctctccccatgtaatctctgcacatgccagctctccaccttccaccatgagcagaaggaactcaccagaagcaaatgcccaatcttgaactttccagctgtcagaatcatgagccagactgggcacggtggctcaggcctgtaagcccaacactctgggaggctgaaacaggaggatcacttgaggccaggagaaagtcagcctgggcaacaaagcaagacctcatctctaaaaacaaattttaaaaatttgttaaaaactcatgagccactacgcctggtgtaaatggtatgtttttaaatttttatttatttatttagagatggagtcttgctctgtcacccagtctggggtgcagtggcgggatcttggctcactgcaacctctgcctcctgggttcaa

SEQ ID NO: 109551 - DNA, 312 bp, Homo sapiens
gatggtcttgatctcctgactttgtgatcctcccgcctcggcctcccaaattgctaggattacaggcgtgagccaccgggaagcaccacaacatatgggaaattcaaagttgggctgtaaataatcagatgacattgatgtatctttgaatataatcagcataaaagatcgataaaatgtgatcctatcagttcgcgtctagattttactgaatctaacctctacctgtttatattgtattcagttaagtatgttcacaaacataatagcacactcatatttattgagtgtgtatgatgtgtcagacacaat

SEQ ID NO: 109552 - DNA, 143 bp, Homo sapiens
gcgccgtcccagatccttcaggggactctgaaggcccatcagatgtggctgcagacccacctccctcagaccctcagctctggatctagaggtttttcttctcatccaatcagaatatgtagtccaagaacctcatttgcata

SEQ ID NO: 109553 - DNA, 796 bp, Homo sapiens
aacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaattaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgccaaattggacggtcacgttcgagaactgattctc

SEQ ID NO: 109554 - DNA, 353 bp, Homo sapiens
agtaagcaaaaagcttagattttcagtattatgttagttgttcattctactcctaaattaacctaatctgtctttatgtttagagagagggggatgagaagcgttaaaattctaggaagtgaaagattagagaagttaggcttaaacatgtatgtaaatatcaaatgttggttctttgagaagattttaaaatattgacaaacctttggctagacttagagagggagagagagaagacataaattactaaaatcaggaatgaaagagaagacatcactaccaacatttatgggggagagaagggattatagagaaactatgaaaaactctgtgtcaacaaattagataaacta

SEQ ID NO: 109555 - DNA, 396 bp, Homo sapiens
actgcgacaaatactttaggaagcattgcgtgagaaagttccttaatccttagataacactttaacgttgtgtctgcaaacaaaattattttgaaatgtatgattgaattagcttcatcaatcaaagaaagggtcaatgggatcagacaaccttctctgacttaaaaaaaaaaaatcttttcagtcaaaattcctaaaagattatgctgataaaaacacagttatagtgaattattttcaactattaaaaggatggaaggaaacagaaccagacgtgatagataatccgggttttagtcttgattatttctctaactgaatgtatgaccgtggagaaaacaatcacatttttgttcttcattttattcatttgtaaaataaaggaatggaacacgc

SEQ ID NO: 109556 - DNA, 176 bp, Homo sapiens
gcggcggctcatgggcctggtatcgcaggacacacgcaggagtctggtttgtatcttgaggataaagagtgctaatgaacatttgcaggggaaggcctcacctcctggcgctccgccgctccctcctctgctgtgctgatccctgtgcacttgctggaaaccattctctctccact

SEQ ID NO: 109557 - DNA, 162 bp, Homo sapiens
tgctttagttcgttcttcttagtttatgtgttgtgtgcaaagtggcttcaagctgtgtgttcttctagccttggccaaacaccctgttaatatatgtcatgaaattacagtattggtttaatattaattgttaaaagttaatagaaaagttgcatctttaag

SEQ ID NO: 109558 - DNA, 576 bp, Homo sapiens
  misc_feature (34)..(34): n is a, c, g, or t
  misc_feature (60)..(60): n is a, c, g, or t
atccttttgttacaattaaagttgctaatttgtnttcaaaattgcaggaaataaagtacncgaatcaaagaaaccaaaatatttaaaaacaaaatagctattctcccaactttcttacttataggtatgtctatacaattgtggcagaatccaaagggaaggacagtttggttagtccatttggtcacagcaaatgtacctgttcatttgttcatcaacgatttgttgagcactcaccttgtgccctgaagatacagttcagaaaaaacaccgaaaaggcccctgtgtccagcagctcacatcttaatggtggaagggagatgaaggagaacagaccataataagtaagtaaacaatgatttcagactgtgccaagagctctgaggaaaacacggtgatatgatagggagcggggaaaggtactttaggtacaatgtcagaaatgcctcccccaggccaggcgagggggtgcaagcctggaatcctagcactttgggaggccgaggtgggtggatcacttgagcccaggagtttgagaccagcctggggtttcaccatgtgaaacccagactccac

SEQ ID NO: 109559 - DNA, 551 bp, Homo sapiens
ctcagactgccagtgatatgaaattcacctgaaccctttacagttggtgacaattgttttaggaaaatatatgtgataagatgctgcaggtcctcataccagtgtcaactcagaatgtcgttcacatttcttctgagagtctccaattggccacattactgagagctttgtcataatgctttaagtcatttatcagctgaggtcactttgacttttgagattctaataaaattggcttgaacttttatcttataccctgtgggaattccaatgagcatttctggaggctttgttttcgtggtggatttttgttagagaactcttggatattccttgtttccgttgcttttctctcttctctcagagttagaaattagcttctttccacaatttccttccacacagctcacacagaccgtggaagtttagggagttggaggaagtttgcatcagagaaatttggaaggatgtttaacagcctgtttgtttgttggtttgtttgtttgtttgtttgtttgttttgctgagacggagtcccactctgttgccca

SEQ ID NO: 109560 - DNA, 403 bp, Homo sapiens
tgtctcacaggtcttggagcagcttgaggaaaaatgtccaggcttgtttgtgcgtggtgagggtgtgcctcaagaaccctccctggctgatgcatcctgttactgactgctctagagagggctgtcccgtctcctgccaccccagtgatggggatgaacaatcccatagggagaatcaaccagggaacttgaacactgccagaagttcttggaaggaaaacaatctggtgattttgttgaaattgggatctagcctttattttgggtagttaaaataagcctctgggtgatatattttgggcctaattaccccggttttcacagaggaggctattgagtgattaagtaaaggtaaatgcttggcatcatagcagctccagaaattcagagcagtttgttcaaa

SEQ ID NO: 109561 - DNA, 376 bp, Homo sapiens
aagaagggaaaaaacaggctaaagaggagtgttaaggaaagagaagagcaccaaatagcaagtgaagtgttttgaggtctgctttgtaccagatgagggttccagagacctttgatttgtgaacgcaactaaatagctgaactaggcttattctgcctatagtttgttccgttgaagcaaagattgtgtgcgcattgtattactcagagcccaggccaaggcaggtagttacagaacagttaattggtgtaggccaggcgcagtggctcacacttgtaatcacagcacattgggaagccgaggtgggaggattgcttgaggtcacgagttcaagaccagcctgggtaacatagtgatccttcctctctacaaaaaa

SEQ ID NO: 109562 - DNA, 452 bp, Homo sapiens
gcactggctccctatccgccactggccatgaaatgcttatactgacctactgacacctggctgagataaagcagttacaatgcccagaacattttattgcattcatttgcatatacatatatttgcttatctgcctggctcttcccactaaaatatctctttgagaacagggaacttttttaaaaaagcctttattttaggttaggaggtacatatgaaggtttgttacacaggtaaactcatgtcatggggggcttgatgtacagattatttcatcacccaggtatgaaacccagtgcccaacactgatcttttctgctcctctccctccttccaccctccaccctcaaggagaacccagtgtctgtagtttccttctttgagaacagggaactgatctctgccatctaacaggtatttattaactgtttaagttaattaatgaattaact

SEQ ID NO: 109563 - DNA, 670 bp, Homo sapiens
caatatttgcccttttctgcctggcttattccactcagcattttcaagattcattcatgttgtagcatgtgtcagaatttcattcctttttaaggctgaataatattctagtgtatgtatatatcacattttgtttatctgtctgttgatgggcatttgggttgttttccttagagtctttatatgtcagtaattcttaaagaatttaaaagttgtagaaactaggaattttgtagatattctagaaatatgtcatttcctgtactgtatataataatttattctacagactaattactgtgtatatatttggttctcagacgtgattttgattttgtagatgctgtacatgctcttcacttcattaatcttttccttttgctaattttggttcttgtgtatacagaattatagagttacaaggtaatttagttgttacctaattcaccctaaagtctacatgaaaccactgtcacagtctttgataagtagttaccaaatctcactatttctactgtgatagtgaatgactttcattgattagctttctgaaagaatagtttatcttacttgtcttggtatcctcacctctgagtctatttgtctattgtaatctggcttttgctccaccgctccactgattaaatggatgagctaagcattttttttt

SEQ ID NO: 109564 - DNA, 558 bp, Homo sapiens
tctataattatatatttatatacatttaaaagtttatatataacaaagtatattcctacttatttatgtgtgtatctgtatttctggagtccttattctgttccattggtctgtgtgtctgttctttcactaatcctgcagtttcgtaattactgtagctttatagtaagtctgaactcagttattgtcaatattctgactttgttcttctccttcgattttcttatttttaaactattatttatactttatcttgtattagacttttttctaatgcaaaacaatctttaaaaagtagtgttaatatatgtgatactgtgtgaagatttagaaaccctgtctggtataatcaaattgaattgggaagtcattatagggaaaagccaggatataatcattttaaatatttgccaaattcccggcatagcatcgtaaacattttagagatgctcagttgaaatttctgacaatgtgatacgatctttgtagacatacaagcttttatcttcttgccttctgcttctcttttcatttctctcctttccttttgctcttccc

SEQ ID NO: 109565 - DNA, 509 bp, Homo sapiens
atcagcagcctcctggatcctgataagcacttgcttgcttagcacactctagtgcggtgtgggaaggagggagatgagggcatggagggtgcagaatgggaggttaatcactgatccataggctgagaggtcatctggtccaatcatcctgatttcacacatgcctgaaaccaatggacacttgaacaatgagaatctggcccattttgaaaagcacccagagatgtagtgtctacccctttcccgggccaaagctgaacagctctcagtccacctcactgaagggaaatacctctcacaattagccctacagatgagagactatctggacaagtttctcagtactgacagatggttacgtagctctgctaatcccaaaccatttacggttttggtcatcagtctttctaacccagagactgggtgagttgtgagtccccttttagatttccacggggactggctctgtaaacccaaaggtcatcagtactgacaaagacagtataaga

SEQ ID NO: 109566 - DNA, 223 bp, Homo sapiens
aaaaatcccatgtctcacagaaagaaaagaaatagggtaaggtaatttattgataaagaatgtactaaccatcatatgatctagtgctcagaacaccaccgtgagattggtcccatcatatattaatatttcccaaacacttttttggtttgttttttttttgtttttggtttttttttgagacagagcttcactcttgtcacccaggctggagtgcaatggc

SEQ ID NO: 109567 - DNA, 213 bp, Homo sapiens
tcttgaaatgacaactccattcttctagtggaggctaaaaactttggagtcatctttgattgttttatatctcacattgactccatcaacaaattttgccagcattaccttcaaaatgtatccacaatctgatctctgtaacccacctccagcaagttcactctggtccaagccaccatcattaaacctggaccgtggcaaaggctttctaac

SEQ ID NO: 109568 - DNA, 395 bp, Homo sapiens
acatgattactaactaagacccacactttactcagatttctttagttttcacctaatgtcccttttctgttccagggtcctatccaggatcccacatgatatttagttttcttctctccctccgtaggttcctcctggctgtaagtttctcagattttccttggttttgatgatcttgacagttttgaggagtgccagtcaagcattttttggactgtccctcagatgggatttctttctcaacgaacctagcctgaggttctggttttagaggatggccgtagcggcaaaatgcctccttcactgcgtcataccaactatcatatcatatcatactaccgacatgacttttatcgctgttagcgttgaccttgatggcctgcctgagtgaaata

SEQ ID NO: 109569 - DNA, 453 bp, Homo sapiens
taacccagctacatgcacacaaaaacccagaagtgaattaaacatgcctggcgctcaaagaatcccttcaaggagaacacagctgcttcaaaaggaagtttttctagaatcactatgtgatttttctgacacataaggtcacctcaaaacccttcctttcacaccctacaaaaacccagcttaattagaaatatggaaataaaaatggtagttatgctgtcaagatttaggagattagtatagatttaaaacccctcaaaatcagaaatacacagtgaaacacatacctcaaaggtatgatgaatatttaactgggggctcgtatcactttaggcataagcacttttccattttgacttttcatattatggccaacttctggacatgttgttaataaactgacaagttgtcaatctagttttaaaacggggtggagtgggggtgggtgcacac

SEQ ID NO: 109570 - DNA, 303 bp, Homo sapiens
ggtatgtaaactgtatgttttctttggctagtactcagccctagcatgtagagggtgtcactattaggtcactcaaagtatgcagctggctgggcgcagtggctcacgcctgtaatcccaatactttgggaggccgaggcaggcggatcacaaggtcaggagatcgagaccatcctggctaacacggtgaaaccctgtctctactaaaaatacaaaaaattagccgggcatggtggcgggcgcctgtagtcccagctagttaggaggctgaagcaggagaatggtgtgaacccgggaggcgga

SEQ ID NO: 109571 - DNA, 560 bp, Homo sapiens
cgaggtgggtggatcacttgaggtcaggagttcaagaccagcctgaccaacatgatgaaaccctgtctctgctaaaaatacaaaattgccgagagtggtggcatatgcctgtaatcccagctatctgggaggctgtggcaggagaattgcttgaaccggggaggtggaggttgcagtgagctgagatcgtgccactgcactccagcctgggctacaagagcgaaactctgtctcaaaaaagaaaaaaaaaaaagtgaaaataaaacataattttacataatacatgacccaaagaggaagtttcaagataaattagaaaatattttaaacaggaaaaaaatgaaaatgacatttcacatcttgtggcatgcagctaatatgtagccttaaaccttatttttaaaatgaagaaaatgctcaaagccataatctaggccagtggttggcaaactttctctctatgtttggacagtaaatattttaggctttctgggccatatggtatctgccacaactattaaactctaccattgggcaaaagcagtcatcgccaatatgta

SEQ ID NO: 109572 - DNA, 626 bp, Homo sapiens
tttaatttatcttcaccaatatcagacagtaatgcattataaaaactcagatggactttgtggaagcgatcccaaaaggcacattctaagatgatgatgcaaaataacaagttatttaaacagtcatatggaagtattttaataaaatttacagttgaaagatcacttctgcaaaaaaaacctacttttagatgtacttcaaattcttaatttgaaaaatattttctattgtatttacttccttgatgtgtttatatatgaaagtttatctcattttatagtgggggatggacacgaaggtagaaatttatctaaaaaacatatttttctctaataaattgagatctagattgtgctaaatttaaatagtgattgtgatgtttatgaaagcatgtctggaaggcagctgtgtctgttggtctggtgctaaggaggaagatctgagctgcagcaagagatggacttgacaatacggacgtggatgagcacagcaaatccagggagagcaggcagagtgagaaaaggaggaaagctaggctggagccctgagtctgatatttaggggaaggaaaggggagaatatcctgaaaagtggactgaaaagaagctgagaggtacgaggaaag

SEQ ID NO: 109573 - DNA, 283 bp, Homo sapiens
ttgagatgaagtctcgctgtgtagcccaggctggagtgcagtggtgtgatctctactcactacaacctcagcctcccaggttcaagtgattctcctgcctcagcctcccgaataactgggactacaggtgtgtgtcaccatgcccggctaagttttgtatttttagtagagacggggtttcgccaggttggccaggctggtcttaaattcctgacctcaagtgatccacctacctcggcctcccaaagtgctgggattccaggcgtgagccaccacacctggc

SEQ ID NO: 109574 - DNA, 230 bp, Homo sapiens
cgagagcaaaactcccactcaaaaaaataaaaaaaataaaaaaagactggtggatgacaaaatacttcagactgcctgtgaactatcaacataatgctcatgtttccttctccttttacagatgatgaaactgaaacccagatggctaatgtaactgtaaagatcacacaaatattttatgatgttgctgtaagcagaacctaggtcttgtggctcccagtccagtgatt

SEQ ID NO: 109575 - DNA, 268 bp, Homo sapiens
gcagaggggctctgctgcctagcatttaaaagaagagggaagtaaatatttctgaggtgagtcagtaaaagtaaagaaatgcttacttcttgtaaatgagaaggtggcagatgaacacatgagggaatgggcatatattcatcccacttgtaaaacatacttcaaaggaggtaggtccaacatcaatttctttatcgtggtactttataagatttccttgtttgcttggttttaattaacagcaaccatacagcattgaaagcgaagc

SEQ ID NO: 109576 - DNA, 460 bp, Homo sapiens
gatgaatgggatgagtctcatagattaatatacaaccagtggtacctgttttcaaacttcattgaacaactaactatttggtcaacatggtcaataacttggatatttactttgtaactactgcctgtacatgtgtgcaggggagtggtgtagatattgaaattccattgtataaatttgagtcttttagaatcttcaactattaggtctggtcagaaccttcatggtcatagtcccattttggaaaactgaaagtcaaaaaacagaagaggtctttcagctggttagtgtgagagataagatttggacaggtcttcctaaccctacttgaactccacaacagccattagctaattaatctttcatttcctcccacaagaggactcagaattggacttggaataaggttaaaaagattatatttcatcagcttcccaggttttactctctttattcctgg

SEQ ID NO: 109577 - DNA, 276 bp, Homo sapiens
ccttcactcagctgtctcagctgtgagctatttttatccattacttgaaagctattgttttatttatttgtccaatcttatttatttatgaagggagagtaatgttgatatcagctacgttattgtgagtgaaactggaagcctcctaaattcttctttcaaaaaaattgtcaaatattcagtaaattaactagatttgataatttgtaaaactctaggatttcaaagttgtaatatggaataactgaatcataggcttgcctaaaaaaatgtttg

SEQ ID NO: 109578 - DNA, 398 bp, Homo sapiens
aagcatccaaagcatccctttggattgcctataagggctgactagatagagtaaaaacaagatttcaagaggaatgcttaaagttcatgagataaattattttaaagtaccattacttcagaagcattatgccaactaagaaactattcttattaaagcaagtgtccaatgaatgcctaaaaaagtcaaccttattctctggcattctcatgatcaatatatgaatatctgaaatgaattaatttttaaaaattgtatttattattttttgaatacagagtttcagtctgttacccaggccggagcgtaatggtgtgatcacagctcactgcagtctcaaattcctgggcttaagagattctctcacctaagactcctgagtaggtaggattacagaa

SEQ ID NO: 109579 - DNA, 352 bp, Homo sapiens
atgaggaacgtcactgggatgaggaacgtcactagctgaatgttcctctcctgactttgatttctctcttggtgagtcggggtgtaattcgccttgacatcactggccatcagcgccacagtgaagtgggccttctttgactcgaagtgacagctcttggcccctgtgacattgtttccatagatttgcaatgaaacagttttatatttttcaaaatagagtgatctcctatgactggcattgatgtggttttcgccatggtcttctggagggtaaagctgtttccattgacccgccctaaattgattcccttattctggcatctggacacattgctcttaggctgcctggg

SEQ ID NO: 109580 - DNA, 518 bp, Homo sapiens
cgccacccaacatgttgccaggaatagagtgctttggccataagatcaactccccaaatctcccttagtgtgatcttattattggtcctttccatttttgatgggggggaaataccctcacgtcctttgtgtgagcctgtgatggattagcacagcttggacggagtgttgctttccaaactcctgtgggtgtgtctccagctgaatgttcctctcctgactttgatttctctcttggtgagtcggggtgtaattcgccttgacatcactggccatcagcgccacagtgaagtgggccttctttgactcgaagtgacagctcttggcccctgtgacattgtttccatagatttgcaatgaaacagttttatatttttcaaaatagagtgatctcctatgactggcattgatgtggttttcgccatggtcttctggagggtaaagctgtttccattgacccgccctaaattgattcccttattctggcatctggacacattgctcttaggctgcctggg

SEQ ID NO: 109581 - DNA, 114 bp, Homo sapiens
atagggttgaaatatacctcaaaaccattcactttaaaatgaaaagtgatgtattttagttaactcttcagaatgtgctgtgaacattacctagtggtgactggatgcgtctaa

SEQ ID NO: 109582 - DNA, 741 bp, Homo sapiens
ggtctagaactttgtattaagtagctgtttaaacactttgtgtacattctgcagtatgcttgaactctgttgaaagtatttcagtggtccccgtgtggtggctcactcctgtaatctcaacactttgggaggccaaagcaggcagatctcctgaggttaggagttcgagatcagcatggccagcatggcaagacttcgtctctactaaaaatacaaaaattagcctggcgtggtggtgcacgcctgtagtcccagctacttgggaggtcaaagcaggagaatcacttgaacccaggaggtgggggttgtagtgagctgagattgcaccattgcattccagcctgggcaacaaaacgagactccctctcagaaacaaaaaagtatttcagtaaaatctatgtatttgaaatagagtcacatagaaagtagagcacatgggatcttcaaaatatattgggtagaaaaatcagaaaacaaaaattattattcattcagaaataaaggagaagaaaaaagggaataaaaaacttcaaggtcagactatgtaaaggtgccctgaaggatacaaagattagaaagcttagacgctgctggatacagatatgtaaaagtgtgagtcagaatactgaaagtaccctaataagtgctttacgttgtaatcacatgggagggataaatgggggttcagatctggcctgctgcctgttgttacgtcctgtgagctgagtgtttttctcatat

SEQ ID NO: 109583 - DNA, 532 bp, Homo sapiens
ttcacacctcacaggcacacagcaagatttagcttcttagacacaggacagacagattacagatgcttagaatcacttgaacccaggaggtgggggttgtagtgagctgagattgcaccattgcattccagcctgggcaacaaaacgagactccctctcagaaacaaaaaagtatttcagtaaaatctatgtatttgaaatagagtcacatagaaagtagagcacatgggatcttcaaaatatattgggtagaaaaatcagaaaacaaaaattattattcattcagaaataaaggagaagaaaaaagggaataaaaaacttcaaggtcagactatgtaaaggtgccctgaaggatacaaagattagaaagcttagacgctgctggatacagatatgtaaaagtgtgagtcagaatactgaaagtaccctaataagtgctttacgttgtaatcacatgggagggataaatgggggttcagatctggcctgctgcctgttgttacgtcctgtgagctgagtgtttttctcatat

SEQ ID NO: 109584 - DNA, 741 bp, Homo sapiens
gtatttcagtggtccccgtgtggtggctcactcctgtaatctcaacactttgggaggccaaagcaggcagatctcctgaggttaggagttcgagatcagcatggccagcatggcaagacttcgtctctactaaaaatacaaaaattagcctggcgtggtggtgcacgcctgtagtcccagctacttgggaggtcaaagcaggagaatcacttgaacccaggaggtgggggttgtagtgagctgagattgcaccattgcattccagcctgggcaacaaaacgagactccctctcagaaacaaaaaagtatttcagtaaaatctatgtatttgaaatagagtcacatagaaagtagagcacatgggatcttcaaaatatattgggtagaaaaatcagaaaacaaaaattattattcattcagaaataaaggagaagaaaaaagggaataaaaaacttcaaggtcagactatgtaaaggtgccctgaaggatacaaagattagaaagcttagacgctgctggatacagatatgtaaaagtgtgagtcagaatactgaaagtaccctaataagtgctttacgttgtaatcacatgggagggataaatgggggttcagaaaattaatgtttgatgcactaaggtaggaatgggccaactatggcctataggccaaatctggcctgctgcctgttgttacgtcctgtgagctgagtgtttttctcatatttaaacggatggagaaga

SEQ ID NO: 109585 - DNA, 581 bp, Homo sapiens
cgttctaacatcctaaaacaactgataccagtttagtctcagtaacacaaaatctctgcttctctacagatgttaccccccttatgttgttgtcatcacagattacacctttatacatagtggggtaaaaaacatagacttataatgcagaccttttatgcatttgttctttagatcacttaggaaatatgtaatggcaaaaaccacaattaattttgcaccaacttaatacaaagtgtacttagaaaccaaaatatagggatactaacttttatacttacctatgtagttacttttactggaggtctttatttttgtatggctttgagtccctgtctagtgttctttcatttcaaccttcaggactccctttaaaagcattccttgtggggcagtctatttgtaacaagcttcctcagcttttatctacctggatatgttttaatttctccttcattttgaagaataattttgccagataacagaattcttagttgacaggtttttttccccctcttagcagtttaactaagccgtcccactgccttctgacctccatgggttctgatgaaaaactggct

SEQ ID NO: 109586 - DNA, 273 bp, Homo sapiens
gaaaaattgggatagaaagaaatatttgaagaaatcatggccaaaatttttccaagtttgataaaaagtataaactgctaaataaaaaagctcaacaaatcttaattacaagaaatatgaagaaaatgaaaccaaggcatatcatcatcagattaggcaaaagcagtagaaaaaaacaaaaattattgtccagcacggtggctcacgcctggcccagcacttagggaggccgaggcagggggatcgcctgagcttaggagtttgagaccagcc

SEQ ID NO: 109587 - DNA, 766 bp, Homo sapiens
ttttcctttttttattgaaacgctgtgtcactctataggagcatgccaaccacctggctaatttttgtatttttagtagagatggggttttgctatgctggccaggctggtctccaactcctgacctcaggtgatctgcccacctcggcctcccaaagtgctgggattacaggcatgagccaccacgcctggcccaagactggcattttaaagatcactgctgaagagtagcccagttctctccctctctaagcctggcctgtccaaatacaaaccaaaaaacagcccttcagcttccattcacaggcagtgaagtccacctagtaacaggtaatgtcccaggctaggtcaagaagttcatcggccttttggccatcttattcttgcctgcctgtgtctgatgtggtgaggggcaggaaacgaaagtccctctccccacactggggtctgaagccctagacttagggaaagacagtgggaggcatccaacttagcagcagaccaaagtgtgatctccaaccaaggaggacgaaaatcaaaactcatacggagaaggagaaaaccttaactggtccagaatgagtagagaaaggtttgattaattaacatctacaaacagcaggtctggttctacgaagtctcgaataagacatgctgagatgctaccttagcccttcgagtaaggaggttcaggatcccaagatttctttttttttttttttgagacagagtcttgttctgtcgccaagctggagtgcgatctcag

SEQ ID NO: 109588 - DNA, 170 bp, Homo sapiens
ctcaaaaagaattgctcagttgataaaggacatgaatatttttaaaaatttattctttaaattaatatatcataaagctcattcttttggagtacagttccacgagtttttaagaaatgcacagatctgtaaccatcacctcctttctgcgatgtggggagttccttcct

SEQ ID NO: 109589 - DNA, 662 bp, Homo sapiens
ggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtatgtaaccagatgttcatgcattttaatttctctgtggaaattattttgtgatgatgtgatctattatttttataattttataattaattatatctacaattattaattgcaaaagaatagtgataat

SEQ ID NO: 109590 - DNA, 173 bp, Homo sapiens
tgttgctaagatcctacctgaaccaactgtgaaaggctttcaagttgaatgtaaattgatgagacgttggagatggaactagcttggggagcagttggagttacagatagaacacagaaatcctggaaaccaagccacacccagtaaacagcaactggctccaactttccctg

SEQ ID NO: 109591 - DNA, 484 bp, Homo sapiens
cacgcacgtacacgcacacatacacaagaagaaagcgtggagagagggtaactcgactcccctgcccccctccccaccagcctgcagaggcgaggggtcggggagaaggagggcctctgctctatcctcccaggtatctaaccctccctgggcagctgtcagcttccatttgcatgaatgaaaactgtggtcaactggtacctgggagagaacaaagcaggaaataaaaggggctgtcacttactcaaatccaaagctcatcaagtctaactaaagggagtgccacattccgcacccccagttcggagggaaggatttgctggctgggccccgacgcccctccccctcgctgacactgacaaaggatctggttctcactgaaactgcttctcttgtgactgtttctagtctccaaaaagactgtatttatatttttaattagctgctttttacagcaattttttaagtattatgatgacttaca

SEQ ID NO: 109592 - DNA, 424 bp, Homo sapiens
caccccagtgacagcatcgttcctaacccagctgcatcctggaccccgtctcttctgaccaaggtgtggaaaatccctttgctagactagaaagagatagaccaacataaaaacaaatgctggtgcttagctaggggcaattttgcccctgaggaacaggcatattaccatgtttggagacattttttgttgtcataactagaggtagtggtgctaatggcatctggtggggacagtccagggttactgctaagcatcctacagcacacaggctagccccccaccacaggggattatctaggcccaaacctcaatggtgccagggttggctggcgcggtggcaaacgcccgtaatcccagcactttgggaggccgaggcagatggatcacctgaggtcaggagtagttcaagaccagcctggcc

SEQ ID NO: 109593 - DNA, 457 bp, Homo sapiens
aaattaatacgactcactaggggaatttgccctcgaggcccaagaattcggcacgaggatggcagtttgctttattaaagatagcaaaggagaaaatctctagcaagatggaagtcactctcctatgaaacctggtcacagaagtgacatctctccacctttccacactgtatgggttagaagcaagtcacaggtttcacacacatttgtggggagaggattgcacaatgcacgggggtgaggaccattgccagccatctccaaagaagctgtgaaccacatgccttacatgctttgtctcacacacacacataatttttatcagttcaacattaagtaaaaagtattcttaaaatttactttgagaaattgccacactgccttccacaatggttgaactatactggataaagaaaatgtggacatatacaccatggaatactatgcagccatgaaa

SEQ ID NO: 109594 - DNA, 761 bp, Homo sapiens
gcacaatcatgggtcagtgcagcttcatcttcctgggcttatgtaatcctcttgcctcagcctcccaagtagctgggaccacaggtgtgtgtcaccatgaccagctaatttttttttactttttaatttttttagagatggagtctcactatgttgcccaggcttatctcaaactcctgggctcaagtgatcttcctgccttgacctcccagagtattggcattacaggagcaagccattgtgcctggcctgctttcttttactaataggcttaatcaactttaataaaatttagattaagatctttcaaatttttttaaaattgattttatctgtcactcatattctttgtccattccatttactatgcattcttatttaacaggtgataattttatattccataagtgcttaaacaccattcattactgaactgcatttttgtttaatttcacataatttttatataagcagtactctttctcagtttctcttgaacattcaactcattagtgagtggttttcccctgtcatttccatttttctttatttggctctgatagttttctgtttttgtttttcagagataatcctttactatactaaattctacatgattatattttccacctctatttgcctatatttatctgttgtcttttccttttccatatatgggctttttttttccctcttcttccttttctacctttggtatttaaaaagttacttaggactgaatgcactggcttacgcgtgta

SEQ ID NO: 109595 - DNA, 162 bp, Homo sapiens
ccagcaccctcccaacttccctccgggctccagctcagtcccgagtcaatatgtccagccccctgtctctgaccagccgttcctactctctctgtgtgacggcttagcctggccagccagccggtgagtggaagcggcggctcctgactcctggtggcggca

SEQ ID NO: 109596 - DNA, 151 bp, Homo sapiens
agggaacaccacccaacgtcttcccccgaaaccagtcctactccctcctacacaacagtggtccctgctcaaggcgcacagttccaaacttcctccacccaaaggctttccagaggatgaagacctcctttaaggacatctcgagaacctc

SEQ ID NO: 109597 - DNA, 661 bp, Homo sapiens
gctatttcagtggggtttagtaggagggataagcaaatggtttgtttctttattgtcttctttatttattggttgtaaatatgatttttaatgagtatataatgttctaccatttttaaaaactacttttctcttgctggtggttttaatttttctgtctttttgctaatataagtaaacctgcattgactattttattatatatatttgtatatatttttagttattattttcttcttaaaaatttcctgagagtatattcagtgggtcagtgagattgtttttagatcaagaaccttaaaactgttcagttttctcaaaaatgtccaaatcacatcagccacatatcagagtccatttgatatatttatactatataggggatgtaaatttacctgagagaaaatcatttgcttataatcagtcattctcagtgttctactgctagtgtcctcatcctctattatctcattcagggaatttttttaggcttcagaactcattgtttttaaggattctttaaaatataattttaagtgattgggtgtagaagccttttccaaaacctaatactagtgtgagataaaactgtagcctgaatatttgtatggtcacaagcagctttactgcatttttgtaaaatattccaacagtacagaaa

SEQ ID NO: 109598 - DNA, 1997 bp, Homo sapiens
  misc_feature (1541)..(1541): n is a, c, g, or t
gggagcatctgaagggataatgatttttaagtggtaccctgttcatgccaggaccagcatttgtacatgggaaaataatcttaagatgagtgaaaagcaaatgctagaccacacctttaataggcccaagtgccaacaaaaatacgtgtgagtgggattcccacggagaaatgtttctgaatgaaaatgaaacccttgataatgaatcctgaggccagaatgccaaagtcacagtattctgtcatttacagcccctaaaaaatcccaggtgtttgtgatgacaagccactattataagtactctgtattagtgactacttggcaagtaaaattttctcaaatgttatttttcatagatctccaagcaacaatcacttgcagtgtatctgacaaaatgctatacatgattttctaaaagtattttgatcactccagaaagaaatcagaataaagctgcataccccaaatcctagaaaattcacaaatattttgctcaagttcaggctctctcagcttctcttttctctttaacttttgcctcatacagaggcaatcttgatgacaaaagattgggctcaatttttgtttttcttatgtagaaaagcaacacctctgtttcggactactgttcagtagacaaaaagcatcccagctttcgaaatgagagtccaaattgggttaccactgagattttaaattatgatgtgaaattggagaaggtgaactgtacagggccagacaaataatagagcccactctctgggcagttgcatgcagtcttgctgggtgctgagctgagagactgagagccgcttttgagacgtgttttgaggcatatcttccttaaatttttgctggtgtctgttttttagaagttttgccattagcatttttcactttgagtatctagccatggagaatgctctaaaaaatacaaggagacagggggatgctttatctatttggcttagtcactggttcagggtgaagtttcataatttattctgataatctggaggggatgacctccttcacagtactgttaaagccttccttgaacaagctcatttcactatataacttcctaaagacaaggctgattatttaaggatttcagagatatcatttggggaataactcaccatctgccccttctctgagagtttagcctttcttaggatacttccttttccaggctagaaaagattgattgtattcatatcccaaagtaaaggctcctccaattctatcagatgtggaggcaacagaaaatgactcatgttatttttctctcacttcacagcatcaagaactcttcttgtttatgtgggggccatggtggattagcttgaggaactgtcaaattaaaatgaaaggaaagcaagttggggcaagaaaattctcactctgaatgtgaaagaaaatagcagtgttcttctctctggcaaagatttgtgtactgttgggggaagattcatgttatttctcaggtagactttactttttgagattctgtgtgtgtgtgtgtgtgtgtgtgtgtntgtgtgtgtgtgtgtgtgtattttgcctggtggggggttaaaggcagatagaatgtagttgtttatgagtttatactttctctttagcataatagatgccctgtttattttctcagaatgtgacaataaaattaggaaaggagaggaattcagaggcccatgttgcagttcatggcaaagttttacccaaatatttccttcagaaacatttagtcatagcaagccatataaattattgtctgcaactggtatcagaaaaagaaatcagtaggtggggactgtagaccccaatggtgcatctgtttacaatctttcttttccaaggttttaaggttcatgaataacatgagggaattttgggagagctaccacatcagtactttggcacgcattaactgttccacaggaaaactagggttgcttcagggctatttttgtttgaaatgacacacatac
